United States Patent 12,491,220 (COMPOSITIONS CONTAINING INDOLE-DERIVED METABOLITES AND METHODS OF USE THEREOF) - sequence listing, part 12

SEQ ID NO: 14 - DNA, 3412782 bp, unidentified (residues 1-1,706,391 of 3,412,782)
  source 1..3412782: mol_type = genomic DNA; note = Lactiplantibacillus plantarum
cggaacagcaaatcgtccaatcacattaccaagttgctctccaataccatctggcagagtatgaataaatactacgaatacactaccaatgtactttgataaatctattaaatcatactgttttgaatttcgaattgttttcacaatcatttcctcccaaagactgaaacatactataaagtatcaataatacagtctagagctttcattatggtaattctaataacttattgaatgcatagtattttcctgctgtaaaatcatactggactaattgatattcacggagcaatttcttttgtgttttcgatagtttatcatcagtaattaagttcagcttttttttatcaattaaattcatgctaccgttcggcaaattaggatctgaggtcttcgaggaaaccttggaagcaataactggaagttcggaattaactttgtgtagcaacgcaaaatatgggattatctttgttttctcgtcatcaaataatgcacttgcaaagccatatgtgcccattacctggttgttttctttgttcaactgtttatgattggaccaaatgaagtatggcgtctcatgtgcttggacactatatttttgaaaattcaaatgatcgtatattcctggtaggtgatctccataaaacacaacagaaacattctgcttcaattttgatagcctctcaagaagatattggttagcttcgtccgtgtattttaatccttgtgcgtatgtttcaacttgacttttctcatttttagagaggtggcttgtcaccttaaaatcattatttttataataatccttattatatagcatgtgattttgcattgtcgaaatttgataaaaactatttttaggagaagttttgagtttgtccaacaaaaacttatacgtggacttatcagacacataagggttcttactaatctttttcgtatagttatttggaataccatgatttaaatagtagaagtcattaaatttcatttttttgaacacttcttcacgcgaatatagcgtacctgaatatggatggattgcgtaactatgatcaaacaaagtatttattgaaaatactttcctttggctcggtactaattgcgtgtacggggtaggtaaagtagcagaaaaatttcccatacttaatccggttaatgcctgatactccatatttgctgttccaccaccataaccatcgctaatcattgacccactattcgtatttttcattaattcccgagtatatggaattggatcagaatttaatttgacgcctggtacattagtcggatcactaaaactctctgaaaggataaaaatgacagtagtattatttgcgtctctgtgcttattcaactttttagcatattttgtatacttagtaacgactttatccattgttttctttgaataatttatcggcttatccattgaagttacattcaaattgttcacaaaattaatgatgggtccattcgattcaacagcctctgctgaatcataatatattggattatctccaaatatctgtccaactttataagctatcgtaccttgattctggatattaaacaaatcccagaagcaaaaaattggtactacaacacccacacatcgtgccataacaggcatattgaccttaacacttctaaacataaaataactagcaactgacaaaacaatgacaataagaacactaccaaaaagtattactggatttaccatttctaggatttttcccatagatttcaacataagtaggtctgagggtaaaactccctcttttcttaatgaatacttttcatagttgacaactgaaataatcagaactatgttcaaatatagcgcaacagtaccccagtatgacttagtcactgagagcaataatacaaacagcagcacaagtaccaatattgctaaaacttgaactctacttcgcacgacaaatacgttgtgaaacataactgagaaacttgagttcccagacttaagtaacataatgtatgagaccaaaattatgattgtactaagaaaccatataatattttttttaattctaatgacattcacaatccttatttaaataaattacttacttagatctgacactttattgaggatatccggttgaataattagtattaagccaatataagtaagtatccccacaactacctgccctaacagactgaacaccgaaattttcattgttacatttaaggtgtacacaatcatacacatgcaggatccagaaagtagataactaataatattcttaaaaaaatgtcgcatttgaaagtcatgacgtacaacaaacaattggtatgcagttacacaaaattctgatattacagttgcgagcatagctcctttaacaccccaggcaataattaatggaatattgacaattatattcaccaatgcacctaaaactacggaaactgtatattgtgccgttttcttagtcggcaacaaatattgttgcccaatcacattacttaacccaataaataaaatgacgggtgattcaatcatcaacaatgtatttacggatgaaaaatagcgcccgaagaaccacggtgctaaggttgttgaaatagcagctattccaaatcctaacggaattgatataaaaagtacaaaatcaaacgacgtgtataagtattgcttaactttttctaactgctttttggcgtataaattagcgatatgtggcaacataacagtcccaattgctgtcacaactgctaagactagtttaattaatttatctgagtaatcataaaatcctgatgctgagactgaatcaagcttccataacatggtcttattcagagctagataaacagtcatagcaatctgaggaataaaaagcattatcgatggttttaaatgcttaaacatcgcaaaaaaattaatagttggcttatcaacatttcctaaaagatacggccacagcgtcaaatttcccagcaattgtgagatagacaggaccaaaatatactttcccacatcatgtgatgttctgacaatcagaaaagttgcagcaacagataatactttaataactgcatttcgacttacggtctttttaaaatcttcaagccccatgaaataccatgaaatatcaaatgcgcctgcgataattaagaatgactgataaaagaaataaattttatattgtttttcgaaaaacaaaaacattaaaaaaaacaaatatgctactgaaattgtgaatatttgtaaaaattcaatttcccaaaatacacgtgagcgctttttaaaatcatcacgaataaatgcaatttcgcgatttccataaatagttatgccaactgtaccgaacaacaaaaagtatgtaataacagaatttgtcgtggcatttatcccaacacctactggatgaagtactcttgaaatatatggtactgttaataggggagtgaaaagtatcaacaaattatagctcatgttgtacagataattttttactagcttcatattttctctcctctaatatatctacataacatataatccttctaacaaactaatgtgactttttccatctgactagttgtttaacaagtagaatactcacacctactaataacactattacgcaaaacacactataataaaaactttttacaatttgtatctgtggggtcatgccggcgctcacgtttgcaagcccagaaatatgtgtcctaatcgttcgatcatttgaactccaataaacaattttattaggagcaaattttttcgaatattctaatgctcgaacctgagtattcgacgtatgaactgttctaacaaaatgatacccatgcaactctcttcccagcgctcgcaactctttcccagctaaattcaatctgccactattttcaataccgtagttagtgatcttatttgaagtattaaataaagtgaaaaaaggcatccctttttcatctaagattaacactgcacgactcagatatgccgcttgctgctgataactccaaacgcctaatctttgctcgtaaactcgagacttattcggaattgaatatccaaattcagtgactaaatatgggttcttaactgtatactttggaaataaactgagtaacgactcaggtcgtccattattattatttttattaagataaggatgaaaactaacaatggaagaacccctatatgccgaactattctttatctgagtaattagactcttactgttttttggatttccctctaaatctccactgacgaaaactgcatgcttatcatatttttttataatctctgccatcgcgttatcaaaactcagccattcattgatgactttctgactcactgggcttcgaacgccattattggtccagaacgcaccattaggctcattccatgcctcccaaacaatccctttattagagttattctttacaaagtgtgttatatccgtagttaaatattcaattgtctgagtatattgttttccagaataatttccaggagttccgccagtaaaattaacaattggtgtcatcttattactaagtgatttatcgattgcatattgtactaatgacgttttccgtttatattctgatccaaacggtaattgatccacaggaatgcgaacatatttgaatccaacctgatgtgcagcattcaactgttcatcaatatattcttttgagtcagaaatattgatatatattccccacttatcagtaatgcctttttcctgagcatttaatggttgataaatacgatatacaaatattaagccaacaatcagcaatagaaaactataaaatactatcatgtatttcttacttattcgcttacccactcagatggcaccacctaatgtctagaatttattttatatacagtattttttttctggtagataatcgtattttcaggtacatcctgtgtaacaactgtaccagcagctaccacaacattatctccaattttaacaccctttaaaattgtcacattagcacctatccagcagttatttccgataataattggggcagacacaaatccttgttctctgaaaagcactccttgttcgtgtaaatgatcgtgatcatatagcttcacattttcaccaaacaaacaatcatcaccaaccacaatctgttccattacattcaatgaacaatcattattaaaaaaacaattatttccaatagttatagatgctttttttcctaatttcacaaaaaaaccgcgtcttacagataagtgctttccagaattaatttgttttctgtgtcggacacaaaataagtaaagtttactctgatatatcaattttaaaagtaaattcattttttagcctctttgtttctatacttatagttgtgaataaatttataaacaaaggatggaataaaagtttttaataagctcaccaaaatcataactgtgcctctgataccgacattaaaatatcgctttgaacgacacaacaatttcacaatattaattctagaccgtatactgcgacgtttaaatgaactcggattttcacgaaacttcagcacaggatttaagagatttgccccagtaaatccagcggcatacatccgcatccataaatcatagtcttcaattcgatacacattctcattttctgaataatttcctattctttgaagggccgattttcgaatcaacattgcaggatgggcaaactgattccctctgaataagtccaaaacgcttggatactctggatatttttgcgtaccatatatttggtcctgatcaaaaatcaagatgttgcttccaacaaagctgatgttttgatgggtttgtaaaaaaagcacctgtttagaaaatctattggcaagactaatatcatcatcatccattctcgcaacgtactctccatttgctagttctatgcacctattcaacgatcgaggtaacccttgattttgggaattacatattactcgaatccttgggtccatttttgcaaattttgctaaaatttgttgtgtttcatctgttgacgcatcatcacaaattataaattcaaaatttgtatatttctgccccaaaatagaattaattgcgtcagtaatcgttttagagccattaaaggtgctcataataaccgaaatcaattctaaattcctcctgaatatacgttctcaatttcacgaatcattttattaagagtatagttttcttgatatactttcacactattttgtgaatattctttaatcaactctgtatgcattctaacagagttgatccactcggcagcactagcaacatcattcaatttatataaaaagccgttgttccgatatagttcattgtgcccaacaacatcagtcagaagaacaggtaaccctgcggcttcagcttctatgactgagaatggaagcccttcgtataatgaagtagacaaaaacagatctgcattttgtaaccaatccacgacgttcttactgaacccaacaaaattgatattggtaagccctaaccgtttcacatattcccgacaatcgttcaataattctccatcaccgacaaaagtaaaagataaatcatctattttttttaacttattggcaattctaatgaactcaaacggatttttctgttcatcgcaccgtgcaatgttaataacatgtttcacttggcatcgtacgcgtggaactgtttcactcaaaattccattttttataaccaactgtttctctacactagataaacgacactgcactgcatgttccttttcctgttgagagacatttataacatagttatatttttgaatatacattcgttcaattacaataagaatcttcttcttcaatggactgagattcttttctgaaagatacgcatgtggcgtgtataccagaataagtcttttagtggtcaaaacactaaataagtacacgagcacagctgcaattgtactatgtgcatgaatcacttgtatattgtatttatttactaatctggcaatagttatcaaacttttgagtatcatgattggatttttatacttggaaagtgaatcattccgaatatatgcatctggaacatcagcattatttcttgcacccgaaactaaaaagaacgacctatactcgtctctgtcaagatatttgtgaagatagtccacatgtttcttaactccaccaccataagattcacatacttctaaaacccgtatcataatacacctcaatcttcttcgctcaatttttgcatgacaccatccaacttttgtaaatactttttactataaagaccacttatcactttctggatttttaatgagtcagcatattttaaacgttcttcgaaaaaagaaaccaagagattatgagcttgcttaatatttccagaatcgtacagtgaaccattgataccttcttgaataatatcttctggccccgttgggcaattagacgaaaaacaaggtataccctgcgccatcgcttcaagaagaatcattggaaatccttcaaatttagaggttaaaaataataaatcagcagttttcacacatttccaaggatttgactgccatcccatccatgtaatttggttatcaatttgataatcacatgcttgctttttaagaagattcatatccgttcccgtgccaataactgttaaatgccacttatattgttttacgctacctaaaatatttatcagttcagaaacgtttttttgcccttcgctctggagccttccaacgtaaataaattcttttacactccctttggacctgggaataacttggttgctaggatcaacagggttgtacactaaactgatgttatctttgggaacaccgacccttactaactgccgttcaattccagaactgattgctaaatgataatcacacaaacgaaaaacatttaacataaaaggaaatcgagtttctcctaatgaaaaatggttccaagaaactaagtagaatcttcttctgaatattttttttgcaatccaagcagcaataatttgtatcttactcatagaaattacaacatctggattattctttagaataaaaacaatactatccccaaagtttgatagggcatttcttttatgatgacagatcactttatcagaaataccttctaaccaatcttcatccacagatccgcctggtaaaaataagcgaaaattattgcttgtcgtattgttctttaaaatacgcgtgataacagtttccattccaccttttccagttacaaatggaaacaccatcagaatgttcataagcgcccctcattttatggtaaataattcatatttttcccactgatacctttaatcccatctaaatagccatccttcaattgctttaaaagataaccgaagtatgggcgatgatcagccttaactgtcataccaacaagtcggcgcgctataaataataaatttgaaggaattagcatcattcgattcgtactatgtttgtgctccatctgaatcctatttcgaataccataatattctttccacgatggtttaaacttttgttggacagtaacattgttataatgatagactgtcgcctcagaaacatttagaatttttgttaattttcgaactcgtaacgcatattcagcatcatcattccaaatgaaatagtccttttctggcaacccagcacttgcaatcaactttctggagaagagcacaccaacaaaggtaaaaccatcaatattaaaatcatgtttgtacgcttcacttgaaattggaacttctttcacagtggcagtatttataagtttccttcgatgtaccaattgaattgaattgtcaggtgaacgaaccgtaccagtaaaacattgaaccttggaattactttgaatttttttatctatgcgttcaaaataatgcttctcaaaaatagcatcgtcgtcagaaagacaaatccaatcggcaccaagctcatatgctttggttaatccaaggtaaaaccccatggatccaccaacattttcttttgttcgcaaataaataaccgtcttattatttgcatattttttcatcatcgttggtgtattatcagttgaatgattatctagcacaatcacatattctggtttaaccgtttgacttaggacactctcaatggcatcgcctagaagcgcctcacgattgaacgtaactattacacttgcatatttcatttgtttcctccaatataaatttacggaacaaactttagattttttcccattctgcctagccatgcatctcttgtccctgcaaaatgaacatataatgcatgttttctttttcctttatacatggatttagttaaaatacgtattgccatgattggaacaaaaaatactaaccaaaagttaacaacgaatctatttcggccacgttctctcacggcaacggtcctatttctaatccagtaatactcccgccaatcagcagggtaagtagtttggacatctacccatttcgtgtgatgaacaattactgagttagagacattgataattttcgaatattgcctcacgcgtaatgaatattcaatgtcatcgtaccaaataaagaaatctccatgaggaagcccaatttttttaatcaactttacgttaattacacaaccgcaaaaagtaaatagatcaatgcaaaaatcatgcccgtattctttttcaggaacggcgttatgggaaaaataattccaattagtgatccggtttcgctggtcaagttgaatacgaccattgggcagtttaatcgtaccggaaaatgctttaacatcaggattctgttttgctttttgtgaaatattagaaaaatatgcttgctcaaatattgcatcatcatcagacaaactaatccaatcaacatcatactctaatgctagtttgacaccaacgttaaaaccaccagacccaccgatgttttctggcagtctaacatatctgaacactttattatctaacaatccagaatcagctataagttctcgcgtaccatcattagaattgttatcaattaaaataatcttttgtggtttattgtcctggttcaaaacactattaatcgcatctagcaggagcgcttttctattataagtaacaattacagatgcatagttcaaaattaatcctccaaacacttagctattaaaataaaaaacattttcatttaggcagaaatttcaagttttttcccattttcccaataatagcgtctcgataagcaattgaattcacgtaaaaagcatgccatctgtaacctatataaaatggtttgctaaatactcgaatcatcattattggcagaaacaagagtagccaaatcataacacttagcctattttttccacgtttattcaccgtcaccactctattacgtataccatagtattcacgccaatctggtctatatccagaatctgcgcctccccaattggtatgatgtaccaatatagaatcagaaacattcataatttcggtacattcgcgtattcgcaaagaatattcaatatcatcataccaaatgaaataattatgatatggcaacccaatctttttgattgtactagcgtttattacacaaccacaaaaagtaaataggtcgatattaaaatcatggtcatactcatccctggagactggctttgccttgagatggttccaatttgtaatccgattccgctgatctacttgaattcgtccatcaggcaacttgattgtgccagagaacgcttttatattcggatattttactatggcaacttgaatttgattaaagtagtcagtgtggaatactgcatcatcatcggataaactaatccaatctacatcatactcaagtgcaatcttcactccaatattaaacccaccagaacccccaacattttcaggcaatctcacgtaccgtattaagtcattattcatcaagcctgcttgacgtacaacttcctccgtcccatctgttgaatgattatctacaataactatttttttcggcgcgattgtttgcttcaaaagtgcattgactgctgaaaccagcaactcttttcgattataagtaactattacagatgcatatttcaaattttatcctccaacaaatcattttgtgccaatacattaaatatgcgcaccattgataagaaaacaacaatatacaatggatgcatccagtcaaaagacataagaatcgtaaacacagtaaacccaacaaaaaacctcaaataccatacatacatccaacctatagtgttgtccctaataggctccaaccaggtacccgtaattttaagaattctatagattccgtaagtaactgttccgaaaaagattattccaaattgtgcaagccaccctgttacgacagataatactgcaaaaaatccatctccacttagaggccagtagctattaaactcaggattatatctcatgaaatttggcgctaaaatatagctccaatgtccaccattgttatagccgacacccaatccaaaactctttacaaagattttcatcattgtcacagcagaacccatccgttgagcaaaacttgtattggagaaagtaaacttgtcgaatacaactcttgttatagtactagagaaactcttactaaaaatcatagatataattaatacaagtattgtccctcccactactgcaaacacttttttccaacttttaacaacaataataatggttaaaaacaagacaatcggtaacccgagcatagcagtagtagatccactctgaaacaaaataataattattaaaataagcggtatccatatcttatattcaatcttttttctttcacatgaataggacctttttaatctagtcagcaagtatggaatgaacacaatcagtaactgtgcagctaaaaatccagtctcctgctttaaaccgttaattctaccagttgtcaccgcgtacgacccttgtgcataccatgttgaaatcgctgttccaccgcgctcctcaaataaattcgcaacaaaattcacgagctcttttccaatcccgaacttgatgtatataagttgcgctagacaaacaatcaaaagaatccacattgcaatttcaattccatcaaaaaaacgttgtatgtcatcatgagattgaatcataaacgtaatgattacataaaataaaacgtatactgcaattagcattatagaattcttcatagaggaagatattgatgatcctgaatattgaggttgtacaatcttagaaacaaacactgtaataatctgagtgaccaataacagtattgaaaacaggcaaatatatttaaattctgtcatcgataatcggacatttcttttattgaatagcatcccaatacacaatatcaacaatgaaatagtggcgtatgactccaaaggcatataaccatgtggaattgttttccctaataatgataacggtaataaaaactgcgccatgactatttctccttaaccgtatcttgacctaatgatttaagaactaggttctcaaacgatgttgcaggtgaataattccccataataacataaccgctatcaccctttgagttgaagctagaaaccatgtattgatgatcagcattgtaatttatattaatttcaccttgattgctctcaaaaatatcccgaatattattaagctgatgatctgttaatccaaaatgaccatttaacaatgcggtcataaaagttgcaaatgaaagtggcgtggcaaccactgtattttgctctactttgacttttgaattatactgaattgttttccgatctgtttcataaagctgtgcaatattcatactatttttataggtcgcatatgtcccaaatgatgctaaaccaatctttttgttgatattttcagaaataacattctgataacgttttgaactaattgaaccgatgatttctctacaatactggttgtattttgaaactttcattaagtcggtcttacccgaaataatgaaggttccatttttatatacgttcttagcctgttttaaaaataaatttaatgtagctttcctatatttatcgttaatattaaatgcactaatcttttcattggtatttaattcattgttttccactagcctatcaatcagtaccagattgacaagtaatgttagattatcattgggatacattgtattgatggtatttggaatcctgtaggcgaaatcttgattagcatatggtttttgaaactcaaccgttttcttatcaaaaaacaatactgtgcccgaaaaattatgtgcttttaactggtcatctaagaacttactcttagtgtcaaatccatattcggaaattaacccattattagaaaaagctttatctgcaattgcttcagtacttttagcattaataactgtctttttattaaccacatatccaagtccaatacaaagtacacctaacaaaacaactattataatcaggtgtccaaataacttacccttcttcatacagtgcacactccgtctaatcaatccaaatgtaacccaaaatcttctttccctgtgaccgcataacattgaccactcgttcaatctgtatccagcgcgtatctgattgtgaaacaactaacacaacttgatctgccagtaacaacatttcacttaacacctcatctgttaggctcagtgtattaataggcagaatattatgttcaatagatccgctagacgttctgatattgttctcaatcctgataagatctaccagattatcattatccatcaactgaatcggctgaatcgttaaactattaatttgagtttcaattgtttcctttttcgttctatctgttgatatagcgacttgttttactagattcgattctcgttcgtccacatagacacacgtgttctcattatcatttgcataagcaatgccaaggttaagactgacactacctgccctttttttttcggaacagtctacacaagccaacacactattattttcttgggtggcagttattctgtttttaatcagatgaaaatcattaaacaatttgagctttgagccttttacaatatttacgttcttagtcactatctattccacctcacatatatcatcgctttttcagcttaacactgccaagactgtctaattgaagccgaatacgtaatgccatttcgctcttaactgtctgagagaaaaagtcatgctttacagatactaaaattgcaatcaccattcctaaaatgaaccctgccaaggcttcgcttttcatgttaggataaacaaaattagcatttaactttggtttgctgtaaataagcaacggcactcctggtacatagtttcccgaaacttttaataggttattcagtaccaattggttgaccttgacagccagccttggattagttgatgttgtgttaattacaacattttgtgtgccagtctccacgcttgctccaactattgatgcaacttcatctgcatctgaactaaactcagagctgtttttaagttggtctgtcactaattctataactggtcttccagatacaagcttctgaattgataaagtttgtgtcgacgtataatttgcactagcaattgataccttcgaggtaaccatgtattttttgggaataaataagtaggctaagccaccaataatgagtgaaaaaaccaatccaactattatccactttaacaacttcgataatgtataacgtaaaacatcaaaaatcgtcacttacttttctccttaaaaatctgctttaatttccttgcttacagtcactaacgcagcatgaataacctgatgcatatcatagtatcgatactgccctaagcgcccaccaaaaatcacgttgccttcttgctttgcaagttcagcatattgtttgtacaacgtgttgttacgagtattgtttacagggtagtaaggttcatccccacgtttccaattagccggatattcacgggtaataactgttttgtttttgtcacccttaccgaattcaaaatgtttgtgttcaatgattcgtgtataaggtgtttccgcatccgtataattaataacagcatttccttgatagttgtcaacgtctcgttcttcggtctcaaatcgtaacgaacggtattccaattctcctaattgataattgaagtattgatcaatcattccagtaaatataatctttggaaaatcggctgaatactggtccttgttagcgaagaaatccacaccggtctcaacatcgatttcaggatgatctaacatcttttcaacaatttgggtataaccgccaattggaattccttgataagtatcattaaagtaattattatcgtatgtgtaacgaactggtaaccgccgaataataaatgctggcagatcagtcgctttttgtccccattgtttttctgtatagcccttaattagcttttcataaatatcggtaccaatcagtgaaatggcttgttcttcaagattcctaggttcaccgcttgattgtgcagcatctttttgttcctgaatctttgcttgcgcttctgcaggtgtgcgaactccccagagctcactaaaagtattcatattgaaaggcaagttatacatatgacctttatagtttgcaaccggactattcgtgtaacgattaaattcagcaaattgattaacatactcccagatttgcttatctgaagtatggaaaatatgcgcaccatattggtgtacttgaattccatcgacctctttcgtataaatgttaccagcgatatggttccgtttttcaatcaccttaacacgcttaccgcgtaaagctgcctcatgggcaaaaacagcaccaaacagtccagcaccaacaaccaaataatcatacttactcaatttaatttcctccaagaatataaagtctcatcatgtcattatatcaaaaaaattttaatgtaaaagggcaatcgttatattattgtataaacatcgataaaaagacgactatttttacaatagccgtccaaaataattatagtattatctacccaatcccaaagaacccatgcataaacaacgccgcacaagcagccccaacgaaaggtgcaatcccaggaacaataatcccgtattgccagtcgctgtcagccttgttcttaattggtaagatggcatgggcgatccgtgggcccatgtcccgtgcaaggttcatggcgaatccagttgggccacctagacccatcccaatggcccagactaagagcccaacaccaatcggcacgattcccggcgtcttcacttcagaaatagctaaaatcccagaaataaaaataaatgtatcgaagaattcgacgaagaagttccgtggtaagttccgcacagcgggtgcggttgagaataagttccgaatcgtaattggggaaatctcatcagcagaagcggcaaaatggtccgcgtacatgatccagacgatcacggcaccaacgaccccacccaaaacttctgcaactgaatacgggataaacaatgaccatgaaaggttccctaaaatacattgggctaataccatggccgggttaatgcagacattgccgaaaatgaagagagcaattgtaatcccaaacccccatgttgtaattgcgaagatatggccggaaccgcgatacttggtcccctttaaaacctcactacaatgtacaccgacaccaaaaataatcatcaaggcggttcccatgaactctgccaaaagctgatgaatcactatctttctcctcctgtggcgttgttacgcctgtttattttgaaatagacgccacttactttcagaaagtaccggcacttttttcacacgaacaccattatacacaaaatccgaatcgtttaatatgtaaatcgcaaaaagttttgattttacaggattaaacgttcggattcaattaaaaggttctgattattcttttttagtcgtttttttgcgtttgaagaattgtcgccgaatgcgacgaatcatccgtggagactttggctcaatcttatgctcaaaccattcctgcaccgacgcattgacgacgccaccaaacatcaagagaatcccggaaaagttcaaccagaacatcagtacaattaaactcccaatcgtttggtaagtcgtaatccgtttagcaaataattcgatatacacccggaacccttgcgagatcacgatccagccaatcgtcgtgactaacgcccccgtccaaatgtaacgcaatttcaccttggcgttcggtacaaagtaatacaacaacatggcgacgacgaacatcccaacaaaggtaatcaagttcttgttttccaacaactgattaatccaattcggaatgattgcacgcgtgagatttgttaaattcaagatcacatctagaatcaattgactcaacgtgaagaaaatcgccagccctacgattaggagtaatagtcccaacgttaagaaaaaggcaataattcgcgtccaaacggcattttgggcatctgtaaccccgtacgcctcatttagactcctgcgaatcgcagcaataattttagacgccgaccagactgtcaccaaaatcccaattgacaaactactactgctgccactagacaggaacgaaactaaaatcggcttaaacgtctgatagacattactaggaataacttcctgagcgtacgctaaaatctgcccagacttcaaatcgaaccgggcaatgaggtttccggcaatcaagataatcggggcaatcgacattaacgcgtagtaggccagcacaatcgcattattgctgacattggcttgtccataccgccgaataataatttccaggcttttcgcaattttagggtaacgggcttttaaattcattcatttatcctcaacgctcacttatagtatttacaattatacaatggaatgccgcgggaaacaccttttatactaggattagtgctttcggcgaatagactagtcggtccaatcagatcaattgatggcaatacctgaccactgatgagtaaaatccgcttatctcccagccgtcagccactttgacaaaatcaagtagctgcctagacgctcagtagtaccggacccatctagattttaacgcaaaaaaataaccggtattgatacccccgcggcatccatatccggctctttcacatctttacggaagaaatgaaaatttttatcactatgtcagtgcttaatattacactgtttatacaaaaatgtaaataattttaatgtgtaccaattgttttcataatcgcttgtaagatgtattccgcagcatgaccatcgccataaggatttttagcgtctgccatccgttggtacgcggcggaatcatctagcagactggtcattgctgccgcaacctgctgaccatcagtgccgactaatcgtaacgtccccgcggtgaccccttccggtcgttcagtagtatcacgcaagacgagcaccggtttattcagtgacggggcttcttcctgcaccccacccgaatccgtcataatgaagtaactgcgcgccgccatgttgtggaaatcaagtacgtcgagcgggtcaatgaggtgaatgcgatcggtatggccgaggatacgtttggcgaccgtctgcactgccggactcaagtgtactgggtagaccacttcgacatccggatgctgagcaaccacccgtttgatggcggtaaagaccgcttccatcggggcgccctgattctcacgccgatgcatcgtgagtaagatcatccggtgcccgggctgaatcaaatcaagcgcagcgtgttgatagtccatcgaaaccgtctgttttaaggcatcgatggccgtattgcccgttaccgtgatggccgcatccggatggttttccttcaatagattctgccgacttaattcggtcggcgcaaagtacatgtcggccagcacgtcggtcagctgccgattcatctcttcaggatatggcgagtacttctgccatgtccgcaaccccgcttccacgtgtccgactgggatttgatgatagaaagcactcacactagctgcaaacgtcgtggttgtatcgccatgcaccagcacgatatcaggcttgactgtatccataattgcatctagcttcgtcagtacccggctggtgataccagctaacgtctgattaggcttcatgatattcaaatcatagtccggcgtaatgtgaaaaatcgtgagcacctggtctaacatctcgcggtgttgagccgtcaccgccgttaccggttcaaattgtggctgttgctgcaactgcaacacgatgggcgccatcttaattgcttctggccgcgtgccgaaaatcgtcattaccttaattggttttgtcattaactttcacctgcatcatttagtttctaatctcatcatagcgttagttacgtcgtggcgccatcatttcgagtaaaagtttagttattttcaaggattcagccaaacggacgggtaagcaaaaacaccaccctgattgcaggcacacgttctcccgcaattaagatgatgttcagcccgtaccgtttctaaaaaggtaccgtcttcaataaaatatcacgaatcttatacgcgacctggttgtcaccaccaaaaacaccctgattttcaaataagactaaggcgactttggcatttcgcgaccccatatagtagctatgaaaattattgtcattgccacccactcgaatcaactggcctgcctggtaataaacgcctgccgaatatttaatttgaaaattatccgcaagtgactttaaaccggcttcgccaactagctggccgctttgaagcccatacataaatttataataatcccccacactcatatatagactaccacagcctaattcactagattgtaacggcttagaaatgatgccactctgaccaaacccattagccaagcgatacgaagtcgggttgatcacattgcccggaatatcgttatattcataggtatgttttaatcccaatggccgaatgatgtcattagtcaaagccgcctgataggatttatgcgtcactttgcgaatgacccctgctaataaggtaaagttcgcgttggaataggcataagcatgattattcgtcgaccgtaaatgttgcagtgtaaagttcagccgcgccgtctccgttggcaaaatcgtctttggtgtgatctcagtcatccgaataccagaacgatggtctaatagttcacgcatcgtaatctggttggcgtacggaatttccggataaaagtgactcagcttcgtcgtcagactcaacttaccctgattgatcagtttttgaaccatcacgccagtcacagctttttgtaatgatgctaatgggtaagcctccgtcgcagtattgcggacttgattggcatcatccgcataaccatacgtccggacccggacccccgccggaccgttcgtggtcagtaacagtgtccccataatatgatgacttttgatcaactgatcgatttgcttgattgcctgcgcctcagtaagctgaccgggcttcgctttgggcttggtcgtcgtttgctttttcgtcgcggatttgatttttgacgccgcctgctggactttaattgtcttcggtgtcacttgccgtgctccttgacctaattgctgtgatccccacacacccacgccaatcaaccccagtatgattggcaataaacctaatagccaacgccgtttgttcatcatgatcccccctgttcctgatgagtcccgtcagatatgacttgactactttttaattgccccaagcatacgccctcacctttgactttgcatcaaaatgcgaattattgttagtccgccgaaccaaatcgcaagcgctatcaatagcaaggatttaccacaatcaccaaaaattcatcaaaatttagtcaatttaactcgtgcaatttccgaacgtgaccattaaaatgaagattatagttaacttattcaaggaaggatgatcatattgagtcaagcaaccgattatatccaacacgtttatcaagtcattgaacaccgtgatccgaaccaaaccgaatttttagaggccatcaacgacgtcttcaaaacgatcacgccagtcctcgaacaacatccagaatatatcgaagccaatattttggaacgtttgaccgaaccagaacggattattcaattccgggttccttggctcgacgatgccggccacgcacaggtcaaccgcgggttccgggtacaatttaactcggcaatcggcccttacaagggtggcttacggttacacccatccgttaacctgagtatcgttaagttcttaggctttgaacagatcttcaaaaatgccctgaccggcctaccaatcggcggcggtaaagggggctctgacttcgatcctaagggcaaatcagacaacgaaattatgcgcttctgtcagagtttcatgaccgaattgagcaagtacattggtctcgataccgacgttcctgctggtgatatcggtgtcggtggccgcgaaatcggcttcttatacggccaatacaagcgactccgtggcgctgaccgcggcgtactcaccggtaaaggattgaactatggcggttcgttagcccggactgaagccaccggttatggtctcgcctactataccaatgaaatgctcaaggccaaccagctttccttccctggtcaacgcgttgccatctctggcgctggtaatgtcgccatctacgcgattcaaaaagttgaagaactcggcggcaaggtgattacctgctccgactcaaacggttacgttattgacgaaaacggtatcgacttcaagatcgttaagcagatcaaagaagttgaacgcggtcgcatcaaggactacgccgaccgtgtggccagtgccagctattacgaaggttccgtctgggatgcccaagtagcctatgatatcgcactaccttgcgcaacccaaaacgaaatcagcggtgatcaagccaaaaacttgattgccaatggtgccaaggtcgttgccgaaggggctaacatgccaagcagtccagaagccattgcggcataccaagctgccagcttgctatatggcccggccaaagctgccaacgctggtggggttgccgtttccgccctcgaaatgagccaaaacagtatgcgtttgagctggacttttgaagaagtcgataatcgcctcaagcaaatcatgcaagatatctttgcccactccgttgccgctgccgacgaataccacgttagcggtgattacctgagtggtgctaacatcgctggcttcacaaaagttgctgacgccatgttagcgcaaggcttagtttaagccaactacatttaatcgcatcaaaaaaacggattgtcattatcgacagtccgtttttcattattattaatcataaaattaagttaaaccttatcagccggataacccgtgtgggcaaccagttgcgcataggtctcatgcaacgtcacggccgcgacctgccagccgaccttcaaaagcggaatcaaccgcagcgggtcttctaccggcacttgatgttcatgagcgaacttacaaatcgccggtaaaacttccatatcagaattagcaaaataataattaccgctatccgtcagcacaaagatcgtcgcccgaaatgcatggcgtgggtcgagcccttccgttacgtgacaccgaatcgcaccgatctgaattcgccgcaccgcactcagtggcatttcacctagattgcgcccttctggtgaccacaaaacaaccttcgtcggggtcagttcgaccattgcgtacttctcgctcgacgtccccgataagcgccgtaaccagttacgttctggttttggctttggatattcttgtccctgaatctcaaaatgaaatgggaccacgcatttttgcgcccgctcaatggcccgataatgacccgcaatttgatggttcgtaaaaacagatgccattggtttaaacataacgctcacccctctcaccgtcagtatacgctttcatgtgacaatttacagtgatttcatcacgacagttttcattttttgtcgcagtgtttggctgaaaacaagctaaaaatagcggccaaattacaacgtaacttggccaccacgatacttaccagcttggctcaaactatgtgtcaatattcactgcccctatgtgtgctgaccgactcgcagtcacccccgctttgaaccattccgacaagcctggatcaaagtaataattgctgaagtcaccaatcagaccttctgacctcgtcattgcaaccgcagttgcctagtcaactctgaccatcattattatagcacctttgttaacggttacacaatgctggaactcattccttaagccatcaaaaaaagcttgccagttggacaagcttttggatgaccttattcagcatcatttggctgactatcatcaaagtcggctggcatgattgcaaagttgctagcttcagttgacaataatgccgcataggcccggactttggcagacaacgctggaatgatggcgccattcaaattgttcagcatttcttgttcgtcgtcttcgattgatttgttatcagattgacgttcaataatgccaaccatctcaccacttaggcgtacgatggcaaaaacagtggcggataaatcgaacatttcttctttataggtcacttgtaattgagcctgcacaacgtcatcaccgaacgtcttcttaacatccggattggcggtcgtatagctgaattggccctgaccaggattgtcatcgtcttcagaacgatcataaacgatttggaaatgtaagtcttggattgctgagtttaagatttcaatattcatttagccaaactcccttttatatattactcccaccataaaggaaaactgggcaaaatacaatcaaatttgctggctttttgtgaataatccgttaatatgccgttaacgttttgtaaagtcagtaacggacctcaggttgacgctgactcgaattacttatacactaaataaggattttagttaagggggcgttttatcatgacgatccaccgaggattaccagtgctcgtcatcctagcaatctgtggcggcttaatgaccctgccggccaccaacgcacaagccttgcgagttcggagcacccgggtcacaacgcgcgtcaagcaccgggtgaagccgtcgaagcaccattattcgaaacggtcggcccgcccgcacagcactaggcatcatcattaattgattgcaaacctaacttaaaataaccgattagcagccttactcagtggcgaggcgctaatcggttattttcatttcatcgcttgattaaccggcgcgtcactgaatgactttctaaaccaggacaatcgtcgttatcacattcgttagatcttaagaccatgatcatcgccacccaacacaactaattctgtatccgttgcgcattttgttgacgaaccttgttcggtagcgtttcagttagcaagtactgccggatcaggctcacaatctgcttattctgcagtaaatcggagtgcgccgtattcgctcccgttaccgtaatctccgtaaaatgcttgacctgatcttgaaagatgtacttaccgtaattaacactgttatacggcactgtcccatcactggtatagttttccgtccccgcaatcgagtaaacggtcaacgattccggcaaaccagtccgataacggtaaagttccttgaacatactcgtcttagcggtcgtactggtcgattccatattgtacggtgaggcaatcgtcatcagccggtcaatgtgcaccttcggactttcctttagatagcgctctaaaaagagggtccaaatgaggccaccattggaatgacctagcgcatagaaatgattaaagtgatacgtttttaccagcgccttgaatgccgtattcaaccagacagcttgcttatcaatattagctttaccatcacgattattcgcgaagccaatcacgatgaacggctcgttatcattggcagcaatcgacccactatacttgatcgtcccgtccgtctgaaccgttaacttcaacacactgtgctttttcggcgtttcctttcctaattcagtaatcaaactatcaaaccggttttgtgacgcgctcgatccggggaccataataacgggtgccatccgcgtccgaccggtattttttaacgtcttgatattcgcctgactccacgtgtaagccggccaacaaatcccgattaacaggccgattccaaggagccaccgccaccaatatcgtttaagcatccgctttcgcctcctcctcaacctggtttgccagtaagacaaatggcaagtagattgctgtggccaccgctatattgatcagactaacgatcaaagcccgccagtcgccaccagttcccagccaaccggtcaagaagcccggcatcgttctaccaaccggataaacgaccggcggcatccattgaagcttcaacgcgcaccacgtgatgaccatactggccagtggcgctaacagaaacggaatcgctagaatcggactataagcaatcggtaaaccgacgagcaacggctgattgatattaaacagtactggcaaggcgctggtcttggccaccgttcgataattacggttccgtgaacgccacaaaatcgcaatcaataacgctaacgtcatccccagaccgcccacattcgcaaacgcatcaaatagtgtgtggagcgttactggattgggggcgccccacgccgaaccgtgttgcaacgcatattccaaattttgaaccgtactcgtcgtactattaccactaaaatcaaccggaccaatgatgccaatcaaccagtatagattgctgagggacgcgacgccaattattgctagtagcgacgcccccggattactgaatggtaaggtgaagaccgcgtaaaacaggccgtttaatccccctttactgacaaaactaatgccatacccgattgcgctgaacatcagcaaagccgtgattatcggtagccagttcgcgtgggcccgcgccagcaagtgggtctgggtctcgatctcctggtgaatatgccgttgccgtgtcaaatgactgaacagccaaccagtcaacaggcctaccaatagtgcgaggaagatgccctgagttcccaaattatcttctaaaaaccgactgccagcaggctgaccctgggtactaaaaaaattataattgatattaagcatgataaaactaattgccgccgtcaatcccgctaacaaattatcacgctgggcactccgcgcaacaaagttagcggctgaaaaagccgcaatcaccgccaggataccgttgatactcagattaagcatcgtggtgtacgccgctaactgtttgaatcctggtagccagtgactgagataataaatatgattcaaaaaaccattgcgctgaaagattgcttggttcataaaactaacgtacgccccaactaatgcgaacggaaagagcagcgttaacgtatcacgcaaggcacgccaataacgttgccgctcaacgacccgttcgaaggtcaataagctgttctgtgcatgctttaacatacctaaccccccaaagaaatttactgtctataatatacgccagttcgtcggccttgcccactaggtgcgtttaatttcattgcccgacactaatccattataattatgataaagataactggaggtggttataatgccaagccgttacacaaatattttagtacccgttgacagttccgatgctgcacaagccgcttttaccgaagcggtcaacattgcccagcggcaccaagcaaacctgactgcgctctacgttgtggatgacagcgcctaccacacccccgcactcgacccagttctatctgaattgctcgacgcggaagccgctcacgccaaagatgccatgcggcagcgacaacaattcgtcgccaccacgtccgcaccgaatttaaaaactgaaattagctatgggattcccaagcacaccattgaggactatgccaagcaacatcccgaaattgacttgatcgtgctcggcgccactggtaccaactcgccccatcgcgtggccgttggttcaacgaccagctacgtcgtggatcacgccccatgcaacgtcatcgtcattcgttaatcgcaacgcccgctactagtcatttggactggtggcgggcgtttagactaatacagtattcatttcgatttcatatcatttgtggctacttaaacccaaagcaccgttccaaggtaacgtcactaaaacgctgccctgaaacggtgctttctaatattcaactgaccccacccggactcgaaccgggatcaaccgcttaggaggcgggtgccctatccagttgtgctatgaggccattaacaatccgtaaaatatcatctcacggattgtgcattttggcaattactgattgctaaagcgatcacgatttttcttgcgcatcccttttttcttagaatgtttattgtgacccttcttctttttaggtgttgccgcagcgggccgtttccggcttgtttccactcgtttaacctcatctgggtgaccagcactcgcaacgcgatgccgaccgttagcggcgttaccagccgtctctggatggtcaaacgttaacggtgggacgactttatctggtttcgtatcaacaatatgataatcgactaagtaacccggcttgatttcatagttggtcgtcgccatcagcttcttaaagtcacggacatcatggtcgtcaccgaacgtcaagactagtccatcagcacccatgcggccggtccggccactccggtgaatataagtcgtgacgtccttaggcagctgataattgatcacagctggcaattcgggcacgtctagaccccgagccgccaaatcagtggttaacaacaggccgaccttgccctgccggaataaccgcaacgctttttcacgttccacctgccgctgattactggtcaaggcgacgtaactcacgtgctggtggcgtaattccaaggcgacgtgttggagttcctgcatcttattgaagaaaacgagggcccgcatatgatcaacgcgactgattcgtttcagtaagtccacgcggtgccgattgcccacttgcatcgtccggtgccgaacgaccccctgagtctgatcgatagcccgcacatcaattttttcaacgtgttgaccaaaccagcggggtaactcatctaaaattttagtttcggttgccgagaagaagcccaattgtaacgtttcagcaaacgtggcatcgagaatttcacgaatctgatccaaagtttcatccgtcagtaattcatcggcttcgtcgacgatcatcatcttcaaatgcccaagctttatcttaccatccgcaatcagattcgtaatccggcccggcgtccccacgatcacctcaggatgctttttaagcttttccatctgccgcttaacgttagcgccccccgtaattgcgaggactttggcatcgattaattggccccactcacgcaccacgttggtcgtttgcatggcgagttcttgtgatggcgctaaaatcagtgcttgcgtcccttcgccgacccgcaacgcttcgagcattggccaggtgaacgctagggtcttaccagatccggttggtgcgagtcccaacaccgattggccagctgcgagtggctcagccacggccgtttgaatcggcgacaactcggtgaaccccgccgccgcaaatttagttttaaatacgtctaacatagtgcctcatttctatttatcggtatcaggggtttcaccagtaaagtacaggtgccctgactgccgcaaattaaataatagtttattaacatttcgactcagttgtcgccaagctaagtattctgcctggtgactgcttggatcattgataacggccgcaaagtcgcgggcttcggctaacattggattgtcatcgggttgcgcgccgattgcatgctcattaccgtcctcatcttgataagtaacttgcccaagttccgcaggattgtccatcacgatggcgtcacgcagaccgttgatttcagatggcaagaacgaattactagtcttaccaacgttcaaggtcactgtaaagtcagcgtagcgtaaaatagccacacccttaccatcaacgcccgttcgaatcaaggttgggtagtaagccacctcttccggcatgccgaaccagccgaccgcatcgtaggccaggtacacgcctaaatcctgaagcgccccaccggcaaagttcaacgagaagatattcggttcttcaccagccaagacggcgtcataccgtgacgagtacttcatgtaagtcaacgtcgcaccctgaactaaggataacttcttaatctgatccttgacacgttggaaattgacttcgtgaatctgccgcgctgcttcaaataatagcacgtcggggtgcgcctttaaaacggcgtccaactgttcgaattcttgttggttcgccacggctggcttctcgacgatgacgtgcttaccataagcgatggcctgcttggcttgggcaaaatgcagactattaggtgacgcgatgtagaccgtgtcaaaactaccctgactgaaaaatgcatctagatctgtaaaagtctcatccgcatggttcttatcagcaaaggcctgcgcggtttcagcgtgacgtgaataaacactcgtcagttgccattccccggaagcagcggcagcatctataaattgttgtgtaatccaatttgttccaataattcctaattttaacatcgatttgactcctctcaacggcgctagtcaaccagtcgtgattggtggcgcttacgcgtccgattagctcataattctattttaccagttttcgccgttaagttgggccagaaggattaaaagtcacccgctattttgtgcataaaaaaagagccgccacgcgggcagcccttttaaaagcgacgattattgaggaacaacgttagcagcttgtgggccacgatcgcttgattcttcatcaaaggtaactttttggccttcttctaaggtcttgaaaccgtcagtttggatagctgagaagtgaacgaatacatcgttgccatcttcaccagtaataaagccataacccttatcagcattgaaccattttacagtaccatttttcatgaactaaatcctcctaggatataaaaataaaaagtaacaaacacatgttattaacacctataaagaatttacggtaacacaattaaatgatactttaaaacttcacataaatgccaatcacattatatagattaacacaatcacccagtaatttccaatcagaacccaaattaattcaaaaaaattagtgaccgccgttccaaaatcaatcaaatattacgttcattactcgcaggtgacaatgacataaaggctttgataagaaaccacttattacgtgacgttaacgccattttagtggtatattttaactataagatttattcagaaagaaggttgatccagtgaagcggcgtggcgcaatattatttggtttatcattactcgcaggactttccagtacactaatccacagacggcatcctagcacgattgctgacggtgatctcacggttttctacgcaggaacttggacctatcgtgatgaggaacatcaccgggatcacacgttagaaatcgaccctaacatgatgatccgcatcgacggtcgctcgatgccagctactgtcgaatcaatctcatcaagcgcgctcgtcttacttgatcaatacgggttccacctcgaagtacgggctaatgaacaacgacccgtgaccctctttgacgaagccgatgatcgcaactatgtcatcttatcgccaaacgcttgacggcgctaacaggggctaaaaccaagattcatcaaaataagtcgcaagtttgagaaaaatctcgaacttgcgacttattttagtcggcctaacagttcatcagccgttagtttaatttgcgaaataaatgatgcaacgatcagcttttaattcaagccctgggcgataacttgattgtacgccgtcacattaccgttaaataggattccagtaaattcctgacgcgtgccattctgtcggtaaacagctcggtccgtgtaatgcatgaacatcacccgctggccctgttgatgggtcttcgacgtatcgagccagaggtcggtgcttttgagggcgggtttaacgatcaacttggcaacggcgggcgtggaccatatgacacaggagcgattataatcctgggtcagcgtggtcaccagtgccttgagtttggcccgatttttccggaccgcaatcgtctgatccgtgtagtcaccgtaatactggacttggatggcaattggtaaattgccgacgttatccccgaccgttttctcaaagtaagccgcttgagccgccgcagtcgatgaaaaactaaacgtgtgcaccacgccgacacctaaactcgtgccgacgattcgttcataattgcttgcaaagttatcatccgtataactagccccttgagtggcgtgcagatagacgaacttgagcccgtcgctttgtaaggccgcaaagtctaaataaccgtcattttgtgacacggcgacgccccgcacgtcaaagccacttacgacagcgttactacgccaacgtagccaggccaaaccgccccagacactgccaataatcactaatagcactaataaccagccaagccggtaacgccaccgcgcccaccgcgttttcgcatatactggtcgataatgttgccgctttgtcatctcatcaatcctttgcctacagcattaaagctccgttcgcgtttgactaatggcctcgcgaacccggccaagactttccgccattttgatattgccatgaacagcagtcatcaagaagagactgtcgataatactcatctgagcaatcaacgaagtcagcccttccgaacgataattaatttcctccgcaactgagataaaggcaacggcgctgtccttggcaagcggcgaattaccaaaactggtcaatgcaatcactggcacaccttgtgaattcaaggtagccagcacctgcaatgtttgttgattacgcccggtatgtgaaatcacgaccgccacgtcgctcgaattcatctgtgccgcctgcatcagttgcatatcatagtcactattatgggcacacggaatcccagtgcgcacgaacttatggtagccgtctaaagcggcgacggcagagccaccgaggccataaaatccaatcgtacgggcgttcaataacaattcgaccgctcgcttgagatccgtttccgtcatcacctgactcgtctgatctagcgaactgcgaatactattgaatgttgattccgcaatccctttaaaagtcgtttgtttttcgacatcttgaaaagcttccgcattagtttgttcaatcggttcggccgccgttagttcacgtgagaagtcccggaaactactaaaactaatccgtttgacaaaccgtgaaaccgtggccgttgaaacgccaaccgccgccgccaagtctgaaatcgactgcgccgctgttttaatcgggtcggcaattatatagtcagcaatcttgcggtccgtcacacttaaattcggataataagaacgaattaaagtcaggacccgattgcgatgtgctggtgtttgtgtggacaattcggccacctccatgaccaaattttaccacaattcttattaacaccctaaatttcctcataaccgtccccactgattgggacgcagtgggccatccctacccggcactcattcgacggtaccagctgacactaagcccttgcgcgtctgcttaggcttatccaacatataagttctaatcagcgtcacaatttgcgcattttgaggtaaatcggagtgctgggcattcgtaccagtaaccgtgatttccgtaaaatgcttgacttgcccttgatagatatacttgccagcctcgacacttcgcgctgggaccagtccgtctgaatcatagttttcggtacccgcgacggaatacatcgtcgctgacttgggcaatcgatcacggtatttaataaaatcagctaacatttgtgtcttatggttcaaattagcttctgagaaattgtacggtgaaccaatagtcatgattcgtttgaccttgatatcgtcacgattaaaataatgttcaaagtaatacgtatagatcaagccaccattcgagtgaccaattgctttgaaattattaaattgatacttggcagccagcttcttaaatgccagtgagaaccaccgggcctgatgtttgatgttatcatagccgtcacgattattttgaaaaccgaccacgatgatgggctcgttatcgcgggcacgcaacgaacccgtcatcttaatcttatcgtccgtcatcacggtcagcttaatcaaactatgtcgccgatgatcagccttattaagttgtttgactaaggtgtcaaaccgattctgagtcgcactactgccaggaatcataatgattggtgacatctgtgaatcatggcgtcctgccatcgctgccacgttggttttcgtccactgatatgacggttgaatcaagagtcccagaaatagcagccctaatatgagcactaacagacttcgccgccgtcgttgccaattcggttgattacgcatgcttagcacctcccgcctgtgcctgggccgcctgcaggatagtttccgccagccgcatgaacggcagataaatcgccactgatagcgccaagtcaacgatgcctagtaagagcgccaccacgttaccattcgtgccgataaacgcgatcaacggtcccggcgtacccacgggaaccggataaaccacgggtggaatccaatgcagcccgattgccagcgccgccagtcccatatttacgaccggtgcgagcacaaatgggatcagatagatcggattatacagaactggtaaccccgtcagcaacggtccgttactattaaagagcgccggtaacaagctccagcgcgccaccacgtgatagttgcgattattactaccgatatagatggcaatcactaaggccagtaacatccccgttccgccaaacgtcccaaatgcatggtacaacgtattggccgtatagggatacggcacgtgataggccgagtgatgtgtgagcgcatagttcaagttggcagtcattgtcgcactattcgtcaccaaacgttcttggtacgggcccactaggccaaaaatctccaatatcaaggtcagcacggccatgccaaaggtcagccacagactgtgactggtcatcgcatacttttgaaaagccgaccagctttcggtggaatacgtgatgatcatcagccagttcaaggccagactcaccgccacggccaatatcagtatcacagccatcggtagcaacgagctaaaagtccgtgtcaaaatatcggccgtatgtggactgctttgggctggaaccgacttactgaaccatttgaaacatagcccggtcaggccgccaacaatcaatgcacccgttaagccgttcgtgccaatcaataacgtgttgaaaatgccgacttgattctgattggtatactgatatgcaacgatcaataatgcaatcgcggcagttaatcccgccaattggtcatcacgctgattgagtttggcatggtacttcgccgcaccaaacgctgctactacggccacaccgttaagcgtcaaggttgtcaaactatcaaacgggtagtgtaagtaacgatagtacggcacccactttgacaagtgaaagatacttgcgataaatcccgtcttcgtcaatacggtcaactgaatgatctgactaaacgttccaatcaaaatgaacggaaaagtcagcatcaacgttcgctgaatgatccgatagaaattcgtttgtcgaaaccacaataagcgtggcactaaccgttgaattaaaccttgttcatcaagccacacgataccgcccccattccggtgatctactgaatctcattataagccgttttgcacgcgactgcctattaaaatctgttataaatttacgtgcgattctgatatcaatcatgcttatatcgaatcattaattcaattgggttgctcaacaacggcataacttacgttgaggtggatgattgacaacttgacctgaccagtcatcgcacaaaaaagtcgatcaaaacacaattcagtgttgatcgacaatcaaaattatcgtttgttcattatgacactaggccagccacactgcgtccagcgtcgtacttttacacaaccccgtactaactgagatgaatattaccagaacgtgcccgaccgtgaatcagatacgtcccggtcgcgccgacttgccccgtctgatagccatccgcttgtcggtcgacccgcgcattgcggggcgcaactacccggccactttgagattccagttcatagcgatagctggcactgacaggcatcacgaccttaatagcgccactgttggcaattaggtcagtgtccccagtgacggccgcaaatgccaacttgatactaccggacttagcggcccaacgaccaccaccacgcaactgttgtccagtgatactaccactggcagcgctagcgacatacgacgccgccgtgactgccgtcagtcgaacccgaccactcttgaccatcaatcccagttgttcagcaatctgaacgtggtcaatggtcatggtaccagacgttaggtcactcgtcattgacgtcacactcaggccagccacgcgcacactcccactggtgacgtttaacgcaacggtcgctaaccgttgtaaaccgcccaccaaaacgttgccggcacgacttgctaaacttaaatcacctgtgaattgtgcgggcactaaaatctgcacgtgtacgcgtagtggaatcaagaacggtacttttccttgaacaatttgtaagttacccccgtgccggctgacctgtgcttgataagccggattgttataattcataaattcccgtacgatcagctcatccgttatctcctgcgttggcaagaccttgatcatcgccgtttgatacctaatggtcagactgatcaaatccgcaactgccacgcgccgttcgttaactaagggtaggcgttcccggtattcaccggcaagatcaaacgcctgcaaacctgctgaggattcctgttcagtcgtatcttcctgttcattgatcccattcgcatccaccgtccaacggcccactttcaacccattggcatccgctttaatggtcccgttgttaatcgagatcccgtcagcatcaatctttaacatcttgccactatcgattgcgatgccatcttcatccaccgttatctggtggcggtggaccttttcagtcgcgccattctcagcattgacttgcttaatcagttcattaatatcgccgaaatcgctgaaggcttccgccacggccgcttctggatccagcccactacgctccttatcgttggcggcttcattcaagtcagtggcaagttccatcttgagctccgtcaaagccggcgttactggttgctgcttaaagtaagtattcagacgcatcgccacgagttgttcaatctttgctgacattatcatcaatcctccctaagaccaaatcgtcaatcacttgtttggcaaaattccactcttcaacgctacgttgtaaggtggtacgcccctgcgccgtaatttgataatacttgcgccggcctccctgagtctcattgccccaataactaccgatatcaccattcttttctaaccgccgaaataccgtgtacaaggtcgcttcgttaatgacatacgccgcgtgactcaactgcttgatggtcttagcaatggcgtaaccatagctgtcaccctgattcaagatattgagcacgatggttgctgtatgaccgcgaatcgtatccttcgaaatttctggtttcaacccgatcgcctctttctaactactttggcacacatagtaatttgatgaccataatataccaccgattactgtttgtgtcaaagtaatttgtctgccaaatatcttttaagctgcgagtgccactcatcaaaacgcaaccgaatactgccgcccgcgtgacacactggcagcacctcatcaaagagcgtgacgatttttgcgcataccaaaagggccccgtcgcaattgcaacggaaccccatgacttgaatgtttatcgccaattgatcttgctgagcacgcgttttcctaatccattttgcaaaataataaataccggatacgcgctgagcatcagcggcaagtaaatcactgctagcggccaatctaatagattaactagcgagaagatccggccaccgaatagaaagactagcacgaacagtgtcgccatcaacacgaccaggccgattttaaaccggttcaatggccgcgcagcaatcagtaacgcgtttaaactgaaaatcccggtcatcaacacactcaacgttgcggtcgtttcaaaattcaactgaaacttatttcctagcaccataatgaccatgatatagccaaccacgcagattgccgcgggaacggcaatctccatcacctgcttcataaagcgcccggtgattcgcgtataatcgggttgtagcgccaagaaaaaggttggtataccgaccatcaacgatgaaatcggcgttaattgaattggttcaaacgggtagctgtgactcatgaagataaaaatcagcgtcaacgcgaccgaatacatcgttttgatcaagtagagtgcggcgacccgttcgatgttgttgataacacgccggccctcgttaagcacttgcaccattgcatcaaaattcgaatcgatcaagacaaagtcagccaaactcttcgtggcttcacttccactcgccatcgcaatactacaatccgcctgtttcagcgccaacaaatcattaacaccgtcaccggtcatcgccacggtatggccagcacgctgataggctttgatcagttgctccttttgttggggcgtcacccgaccgaacaccgtatatgccgccactagctgatcataatccggtgtagcacccacttggctcatatcgaccaaccgatcagcgtccttgatctcagcccgttgtgcaatactagcgaccgtcaccggattatcaccagaaataacttttagggcgacgtcttgattcgcgaagaatccaaacgtcgccttggcgtgtggccgcaattcatccgtaatcaagatcagccccagagtgatcggtgatgtcggcttcggtgtcgttaagccttgcacttctgctaggatgaggactcggtaaccttgttgggcgagcgttttgatacgtgcctgtagtttaggcggcacggtttcataaataaattccggcgcgcccattacgtaagcgtggccgtcaaacgcggcgccgctccacttacggcttgaagaaaatggcaggacttgtgtcggttgcactggcggctgaccgaaagccgttttgatggcctgagccgtctcattgtcatcatcgatagccgtaactaacgcagccaaccgttgctcaacggctgttaacgcatgctggccccacggctcaacgcgctcaaatactaacttgccgctagtaatcgtcccggtcttatccaggcacaacgtatccacccgtgccaaggcctcgattgcgggcagttcccgcaccaatacctgatggcggcctaaagtgaacgcccccgcggccaaagcaactgacgtcaataacactaacccttccggaatcattccgaccatcgcagccacggtcccgagaatcgcccggttctgactctcgccccgcatcatagtggagataaacagtcctgcacctagcggaataatcgtgaaggtcaaaattttgataattcgattaataatcgttaacagttgactcggcgtgcgccgcttctgtttggccgcccgcgccatctgcttgataaaactaccgtggccaacctgagtcgcctgcacgatcccgtgaccgccgagaatgacacttccagaaactagttcatcgcccggccccttaatgactgggtcggcctcaccggtaatctgggactcatcgacttccaaaccagcggtcgtccgtacgagcccgtcgacaggcatctgctcaccccgggtcacaattaggagatcatcctggacgatttcgtcctgaccgattgccgcagtttgcccgtctcgacggacttgaactttagtggccgacaacagtgacaatttatcaacttggcgcttggcacgaatctcttgaaaaataccgatggccgtgttgacgacgaccacgaacaagaacagcatgttcttatagctacctgtcaaaaagactaatccggctagcaaaacattaatgcaattaaaaagcgttagcaaattgtcacgaaagatttgtttcacggaacgtgtcaaaggtggtaacggctcgttctttaggcccgctgtcaggcgctggtcaacttgctcagttgttaacccgtgttcaattgctgataaataacgttctgacatagtgggcccccttaaattaagcttatctttattgtaaacgattttcccgatttaagactaaaataacgcccaaatctgatggttacgacataaaattaagcttttcattatgattttccatcacgcccgcttaatcgctaccagctatcgtctcgatgatggccttcgcgcccccatcagccaccagagctgcaagtcacatccaaaccgcacaccatcaaaagcaaaaaaaaacggctacccctaggatagtcgtcaaacattcatcagttaatcttcagtgccatcagcgggcaaatgcgtctgctcgattgccagctgcatgaccttcgtaaagcgttcatccagttcttcaccctgcatcttgaagaagccaccaatctcttggataatgaacccgaataacgtcgagcggtacaaggtgttttcgacacgtgccgaatcatccagctgcaacggtttaaacatatcttgatataactgaacgattgccttacgtgaacgtggaatcttcaagttatcattcaggtctagcagcaagggggctagtccacggtgctgcacgcaggccgcccggaattcttgggcaaaggccatcaacgcttcatcgccgtcaatccccgtaattttttcagttaaccgatccgccacgttctggacgaattggaggcccacttgatctaataaatcactcaagctatccacataattataaattgactgcggccgcacatccaaaatcagcgccaaatcccgaattgttaacctgttaatccccttactctcaatcaactgattcgctgttgctaatacttttgcctgtgtcagtgttcttctctttaccatcatgctcccccattttcggtttatttcgtttatcattataacccaaactgatcaaaaaccgagatgaaacacatatttttatcgaaattaatagatattaatgagatttgtggttaatttcagattaaaaactacaattattcgcataaattatgcaaattgcaattacacttaaccatctcgttcggtggctgtcaattgcgaccattattctttataattgcacttaataataattattatcaagtgctcgctttattagctgcttctaactgcatttcacacgcacgataaacttgcaagctgaattaatcacaatcacgcttacttcatcgttagcttgccgtgaactcgctacgcttcgtgggcaacatcatgccaggcctattccggtgatcaataccttgtcgacggtcgcacaccaacagttaatccccagtcattgcaataaaaaatcaccattcaagattagacttgaatagtgatgcttactgcctgcaaactacttgtgactgctcagattataaattagcacttctagacaaatgaaactactctcgatatacctagatcactaaaaccgaaataatttatccttctggcttaatcgcaacacaatatttcccggcgcgttcaattgtgaaggcaacttatcactcaaaattgggaacagtatttggatgccctgatgctcagcttcttctgcaatctttacaagttgattaccatgcattaattccttcttgtcataaagaataaagtctaggactgggatacgctcagcgcgtgcaaattggatataccccaagtcaaacgctgcaatttcaccttgcttcttaccagaacttgaattgttataagagaatacataaaagctataatatttctttttggaatcagatcgttgctcgaaggtcacgccatacggctcaccatacatagcttctgacatcgttgaaaaatagcgattgaatttttcaagttgccgatgaattaatttatgagtcgtttctgaaaaggctgaatcatcgacagccttaagtgactgttccaattcatttactttatcacgtgactgatcgatttgctcaatgctgtttgaaatacgccctctagtttcatgaagtttacccaacacctcagaaatctgttccaaatccttggtcgtgttcgtatttcctaatgcttcagtcagcgcatcgattgcttgttttttatgtgctagttcaacccgcatttctcggatttgcgcctctagctggggtagctcgcgaccgataaactcacttcgcgcattgaccatttgattattatacgcaactagttgttcgaatgaaatttgaatattctcaatcagtccttgagcctcattgtataaggctttcaactcatctgtattcacaaacgatttagtctcttcaatctgctgttgagcatctttgatcagagaacgccgcaagtcagccgcggtcaacttattggaaataatcgtccgctgatactttagctcatccaactgattgatttttgtttcatattctaggtcaatgtttagactagcccgtttttgcatagccaaccgaatgtcatcctcatttttggtcatttctaacgtcagttgttctctgggcgttgtttctaaccgtttcaaaaatgcacgctccgtattgagttgttgaacaatcggcgttcgatcaggtaaatgaatgccaaacatgtacataaaaagcgtctcatattccgttacagtggggaatttccccaagaactttaatgtattgtcaatggctggtgaatcaattcgaaacgttcggcctgtgacttgtctaaacgttggtttattatcgggtgggattccaaagagatcctctccaatcttttgggggaactctttgactcgagaaacctgcttaccattgattgtttgaattttatgcttcccgctcaaaaaattacgttcaatcacatacttcgagtttggctcaattttatccgcactctcagacaaaatgagccttatcaatacccgcttctcaatcagatacgctttaacatcagctaaaggctccccagactccggatcagtgtaaattttcttggcatctttaccaaaacaataatcgattagtctgagaaccgttgtcttcccaacgccattcccggtattaatcatttctttcagatcagaagggagtgtttgatccacaatcaagtttaagccgctatgaaatctgatactgcgtaattcttttccagcagcaatgatatcaagctgattgatgtacaaggacaacccctccttccgaattcacttgaacaactgaaattaagtatagccaatttaaagttaactggaacagtttatgagacagcgcctgttgttgcttgacctgctcatataagtctaaccatgtaatcgtgtgatctgggttttcctcaagtttttgaataataatcccacctagaaaatataggctcagttctggacgggtatcagttggtagtatcatattggtagccctccggattctcaaaaattttacaacggataaatgcgtctactagtattactcggcaaaaatattctttctgctccattgtcagggaaaaatccatattagcacttttatcaatatatgtcatcaagtcgtcgaccatgtccagaaagacaacgacagaacgcttatcaggattcctaattcgctggttctgatagacagaaactaatttctgaaaaacaattgccggtgaagtcccttccagtgcaaacaattcgtatatcctatccagctcaggactatacaactgcaacaaactgatggtgttattttgtatcggtttcaattcattgaagtcaattttttcttgaatatcaaacgaattcggtattttaattccagtcgctggactaacctgaattttagcaactaactttaccacttcaactaacagggaggtctcatatcgaggcggctcactagatccaaactcctgatcacagagatttttcaactgcaacaaggtctcaatgtcagcgtcacggcagtctgccaataatcttgtaacatcaataatatccgtcttttcggaaaaataaatttcactcggattttgatatggatgcttttctaagcgaccagcatcttcagtaatgagcacaaatcgcaaccgataatcacgtatcccaaccaaatttgatttcaataaggttttttgaattttttcacgagtaatctgtgatgtcacttgaattacaatttgcgccacctcatcaactaaatcaattgcagcatagttgggctttgtgcgatttgtaccatgtaaatggtactgatagagaatattcaagaattgcgcgaagaaagcttccgcaaacaaatgtccatccaacaaatttaatttgccgtttacttttatcgaatgaaccagcagtagtaacttgtcctcaattgatttaaagtaaacctcccgtgttgacatattcacacctcatcgattatttagataactatatattaaaagtatcccttagtgcccttataaagtaaactaaacaattccctcatcaccataatattctacgcaaaaaaattggtctagcatcattcgctagaccaatttggcaccattatcatttctaaatcaacaacacactacttattgttcccgttccaacaccgttaccgattcaatatgcggtgtttgtgggaattggtccactggttggaccggggcactaatgtggtacccatattccgcaaatcgctgaacgtcacgaactaaggtcgatgggttacaactaatgtaaaccacccgtttaggcgccatttcaccggcactcttgatgaagtcggcgtctagacccttacgtggtggatcaacgacgatcacgtctggttttacgccatcggcttgccacttagccatggctttttccgcactatccagaacaaaggtcgcgttagtaatcccattcttgtccgcattttgccgcgcgttatcgatagctgctggtacgatttcaactccgtacacttgcttggcatgttgggccatcgttaacgaaatcgttccgataccggaataggcatcaatcaccgtttcgttccctgtcaagccagcctgatcaatggctaactgataaagtttttccgtctgttgcggattgacttggtagaaggattgagcggaaatagcgaaggtcaaaccgagtaactggtcatcgatcgttgccttaccagctaacacgttgttaactgggcctaggattacgttagtcttcttagaattaacattttgaatcacactgacgacttctggtaacgctgcttgaatctcttgtgtgaccacgtcagccattggcaagtgcttcgtccgcgtcacgatgacgaccatcatctcatggctgtaatacccacgccgtaccatgattgtccgaatcgtcccgctatgatgaaattcatcataagccgcctcgtgatatttccgcaaaatatcacgaaccactacgattgccttatcgattgcgggatcttgaatataataatcttcaatcggcatcaattgatgactattcttcttgtaaaaaccagtcgtgagttgtccttggacttgtcgtacaggcacttgggccttgttccgatactgcgtcgggttggccatgccaatcgttggtaagacttcaacatcatccatgtggacctttgcgaataattcagccacctggtgctgtttgaatttcaactgttcgctgtattccaagtgctgtagtggcgcaatcccggtttgacggtaaacgcggcccttagggttgacccggtgagggctcacttgattgattttttccacgtcaccaaacgcaaagttctttgtcgtcttcgtgaccttggccgtgattttttcttctggtaatgcattttcgataaagattgggtagttatcgaccttagcaacgcccatgccttgataggttagatccatgatggtaacgtctaagacttcacccttatgcactggtaaattaactttcatttgtttcctcttgctttctttgatagtgacttgttatttttaacggctgactggtagccactgctcagtcaacgtctgatatggccatttgatttcgccactgttggcgtctccgcaacgattgcggttaaaatatcgcactgaaattacaactgacacactgcttttgacgttcataacgaattttgcgactcccgctagtcaaatcacgcggtcttcaccgcccccgttacgtgcaacgcggggcaagcattgctgaaatgcgcacggttggtcgcacggcaatccttacacatcaactagtgacgataacacttaaaaaaattaccgtccaccattgtatcggtaaacggtaatttaagcaagttattctgttttttcgtcgtcctcagttgcagctggcaactggtcaacagcggagacaaagtggcgttctgcgtcttccaactctgggtcggtatccgtgatggcctcatcaggaatccgatccgtatcagcaaacatttcgatatgttgcttcaaattacggaacgtcattggtgcatcaccaccgtactccccgtcgaggttgatcattagtcgatccttatcagctggtttagcaacgactttgctcgtcttcacataaatgatacttggatcattgatatgcttgccaccattgagcactaacgtcatcaggtgtagcatcttggccaggttgctcgtcttcacaataatcatggtaaatttgccatcatctaaagacgcatccggcactaactgctcaaagccacccactgaattcgtcagcgctaagaagaacattgacgctttaccctgataatgaccaccatcgtattttaaatccatctcaattggttttactcggggtaataactccgcgcccttggctaagtaagccgcgtaaccaaaaatcgacttcaattgtgacggcacgtcataggtcagctccgttaacatgcccccagccgcaatgttaatgaaatactgttcaccagcctgaccgatatccatcttgaccgtctggttcttgaggactaccttagccgccgcaaccggatcattgcgtggaatccgcagtgcccgggcataatcgttggtcgtacccgccggaataattgccatcttaggtcgccgctttaacccggctaacccatttactacttgattgatggtcccatcaccaccagctgctacaatcagttcaaacccgtccttggcacaacgccgcgcttcatcggccgccgaattaggggcgggcgtcgttgcgaacgcgctggtctcataaccagcttgttcaaagataccaagaatttcaactaaatcgtgggccaacgcctcacgtccagaagtcgggttataaataagtcgtgcccgtttacgcatgtttcctattcctccgctcacacggtcaagcgttcagcgtctcatctttaccccaacgctggacatgcatcaatcgaggctcaacaccttatcgactaacgctgttaccgtgcttttaatgatgtcattaataattggttgacgactttcgggttagcttggccacgtgtcttcttcatgatttgacccacaaggaagccaacggcccggtctttcccgttcttaaagtcgtcaattgattgttgattattatccaatacgtcgtcaacgattggttgtaactttgccggatcagacaattgaactaagcctttgtcgttgacccatttgactggttctgaacccgccataatagccttaaagaccttcttggcaatcttacttgagatggtttcatccgaaatcatcttgatcatgccagccaagttagttggcgttaagtcggtcgctagcaaatcaaccttatgctcgttcaagtacgcgttaacgtccccttgcaagtagttggacgctaatttaggatccgcaccttccgcaaccgttgcatcaaagaagtctgacatttccttagtttgggtcaagacgcccgcatcataagccgtcaagccaaattcattgatgtaacgttcacgccgcgaaccaggcatttctggaatggtcttcttaacggtcgcaatccagtcatcatcgatatcgacagctggaatatcaggttctgggaagtaacggtaatcatcgctaccttccttgacccgcatcaagatcgtttgcccggtcgtttcatcaaaccgccgcgtttcttgttggatcttgccaccagccatgagaacttgttgctgacgttgttcttcatattctagtgacttgcgcacgtagttgaaggagttcaagttcttcatttcggtcttcacaccatacttatcggaaccagctggccgaatcgaaatgttgacgtcgacccgcattgaaccttcttccatcttcacgtctgaaacgccggtaaattgaatccgttgccgcaacgcttcacagtaagcataagcttcttctggtgaagcgatatcaggcttggaaacaatttcaattagcggcgtcccttgccggttcaaatcgacataggaatagtcgttctcatgggtgtttttcccggcatcttcttcgatatgcatctcttcgataccgatttttttcttcttgccatcaacttcgatttcaatccaaccatcatgtgcaattggcttctcatgttgcgtaatttggtaggccttcgggttatccgggtaaaaatagttcttccggtcaaagtacgtgtgatgttcgatttcagcatgtaaagccgttgctgctttgattccagcttcgaccacgcccttgttaggcgttggtaatactccggggtacccccagtcaatcacgttcgtgttggcatttggttcggaaccaaattgcacgggtgaaggactaaagatttttgagttcgtttttaattcaacgtggacttccaaaccaatcgtggttacaaaattcattagttagcacctccgactttcggggtttgcttataaacttgcgttgcttgttcaaaggcgtagccggcgcgatacatcgtgctttcatcaaacgccttaccaattaattgcaagccaactggtaacccgtctgcaaacccagctggtactgacattcctggtaatccagccaagttgactggaatcgtcaagacgtcgttcatatacatcgtaattgggtcagataattcgtcacccaacttgaaggctggcgttggcgcaactggtcccataattaagtcatagtcttcaaagaccttattaaagtcattgatgatcatcgtccggacttgaccagctttgtggaagtacgcgtcgtaataaccagctgacaaggagaaggtccctaacatgatccggcgtttaacttcatcaccaaaaccttcggaacgactacggacatagacatcttccaagttcttgacatcgtcagcccggaagccgtaacgaatcccgtcaaaccgttgtaagtttgaagaagcttctgaagacgcaatgatgtagtaagcagccacaccgtagcggctattaggcaaggaaacttcttcgaccgtggcacccaagtcttcaaactgcttgaccgcttgttgaatgacttcgcgcaccttaggatcgatcccgtcacccatatattcttttggtaacccgatcttcatacccttgatatcacccgtcaagccggccgtaaagtcaggcacagcttgcttagatgacgtcgtatcatgttcatcgttacccgcaatcatattcaatgcggccgcgttatccttgaccgtccgtgtcatcggaccaatttgatccaatgaagacccaaaggcaattaatccccagcgtgagacccgaccgtacgtaggcttcatgccgacaatcccgttaaatgatgatggttgccgaatcgaaccaccagtatcggaaccaagtgcaactggcacttgaccagaagccaccgcgacagctgaaccacccgaagaaccaccgggcacacgactgatatcccaagggttgcgcgtgacatggaacgctgacgtttcagtcgaaccacccatcgcaaattcatccatgttggtcttaccaacgatcaacgcgttgctagccagcaacttgtcgactaccgtggcattgtagactggcacgaagttttccaacatcttggaagcggccgtggtcgttagccccttcgtcacgatgttatccttgactgccattggaatgccggcaaagacgttgttcgcatcgatgccgttttgatccaaagcggccgcctgttgtaaagcttggtcttcatttaaattcaagaaagccccgagttgagggtcaacctgattcatattagcaaaagtggccttcgctagttccgtggcactgatcttcttggctactaagtcagcgtgtaaactagttagatcttggtcgaaataagtcattattcaccgtccccactttcatcaataattgctggcactttgatcaagccgttagccgtttccggcgcattcttcaataatgcttcccggagtgcttcgtcactcttaactgccacgtcttcgcgtaacgtattggtatggtcactcatccgagacgttacgggtacgcccgtcgtatcaaccgtgcttaattcttcgaacatgccgataattttttccagttgcggtgtaaacatcgctaattggtctggcgtaaattccaatttggctaagctcgccacgtgttgcacttgttcggcattaattcgttcttcagccatcagatttccttctttctcaaatcttactcaatattattgtttaattgtcaccctggtcactaaagacgtgggtgtaatacgaactacccttcgccgttctcgccaagaagctctgaatatcgccattggcactcttgaccgtaatctcaaccggaacaccagatggcaagtagcgttttgcagccgttgctaagtactgcgtgaaactaataatttccgtttcgctgtagaacttagttgtgatgttaacacttaatttactcaacgacttgtccttgtaatgggcatttgccgtgacaccagacaagttcgggaagaagttctgaacgtgggacttaaattgactaaagtctgactcatcattgctgttcgcacccgagtttttcgattcagaagttgctgggaagacgtaattcttccaattcaacgacgtccagttcgaaatcgaggtcgaaccattcttggagacagcataggcaatcatgtcaccaccaactaaactatcattcgaagactgcttataaagtgctaaaacgattggcacatttttcaaagctgaacgttgacgcaggcgttgtaagacggtattcgccatcttcttaccttgcgccgttaattcagtcgttgaaatgtttgtttcgtatgtcgccccatattcaaccttggtgtagtaatcgaccgagttcattcctaacccaatcgtgaccccaccgagtgacaatttacttccattctgaaccatgtaatcttgctcttcaagctgttgtaagtaaatcgggttgcgcgtattcggatccttcttaccgttattctccgggtttaacccctctgaattactgctagatttacgaccaagccaattttcgacagtcgatgagcttaaatactggccttcttggaagacatacttactcgttggaaagacctttttggagacgtctaataagccgctttcgaagctcttcaagttcatgacgttatcattttgtgagacggctacgccccgcgacttgcttgtccgataacggccatttttaatcacaccttgataaaatgcattgtcggcagttccagtcgtggtcgtcgttttcgttccagttgtcgtcgtgctactactcgacgatccaaaggacgaattctttaaattaccgcaagcggccagaacaatggcagctactgccactaaaccaatcgtgcgtatgcgtttaacattcacgcttgtgtatcctccctcattgtttcgctgaaccgggcttcatcccatacggtaatgtccagctgctgtgctttttgcaacttgcttccggcatcgctacctgcaatcacgaggtccgtctttttggagacactccccgtgaccgtggcaccgtgggcttggagccattgagtcgcgtctggcctggtaaagctttccagcttacccgtcagcacgacccgcttgcctgcaaaccaactgttactatcttctgccacggtggcactagggccctgataagtggtatttacgttgaccgcttgtaattcgcgaataagtgtatgaacttcgtcgctcgcaaaatactgaacgacggcgtttgcaatcacatcacccatcgaatcgatcgccgcgatttcctcttggcttgccgccatcaacgcttcgatcgtcccaaaatattgggcaattaatcgcgccactttagcaccaacgtgccgaataccaaggccgaacaataaccgttcaagtgaattatcacggctacggtcaattgctgtcaagagtttttcagcagacttatcttttattttatctaatgttaacagttgcgccttggttagacggtacaaaccggcaacgtcactaaccaactgattcgcataaagctgtgcaatgatccgtggccccaagccgtcaatattcatggcattgcgagacgcgaagtggaccaacccttcttggacttgtgccgggcacttcgggttaatgcaccgtaaagccacttcatcttccaaatgaaccagtggcgccccgcaggacggacaatcggttgggataacgagtggttcggcatccttagggcgtttgctcaaatcaactgatgagatttccgggatgatatcaccggccttgtgcaacaggaccgtgtcaccgattcgaacgtccttagctgccacgtaatcaggattgtgcaaggacgctcgggcgaccgtcgtccccgccaattgaacaggttccatgaccgcagtcggtgtaacgacgccagtacggccaacggtccattcaacatcttttaaaagggtcggctgttcatcaggtggaaacttgaaggcaatcgcccagcgagggaccttgaccgtcgcccccagcgaccgttgcaatggtagcgggttcgccttgatcacgatgccatcaataccgtatgccaattctggccgctcattttgataatggtcaatgtaactaaagacgtcggccatcgaatgggccaccttaaagtcagggttaatggcaaaaccaaggtctgcgaattctgtcagcatgtcgctttgcgtgcgagcagttaacggttcgtaatcggcaatgttgtacataaacgtgctgagttgccgttccgccacaacgcgtgaatctaactgccgtaaggtgccggccgcagcgttccgcgggttcgcaaagacgggctctccagctgcttcgcgtcgttcatttaaagccgcaaacgccgctttaggcatgtaacactcgccacgcacatcgatcgtcagtggtcgggtcaaccgttgcggaatcgacttgatcgttttgatattagccgtaatatcttcgccgaccgtcccgttaccccgcgttgatccttgaaccaacacaccatcttcatatcgcaaggagagtgccagcccatcaatctttagctcacaattatagtcaactggatgacccacgttctgttccaagcggtccacaaattcttgtagctcagcctgtgagaagacgtcgcccaatgacaacatcggaatctcatgggtcactttgtcgaaacctgatttaaccgtcccaccaactaattgcgtcggcgaatctggcgtcacgagctgtggaaaagtttgttcgagcgcgaccaaccgttcatagctttgatcatacacactatcttcgacgtttggcgcgtcttcgtcatagtactgccgacgccattcatttaatgtttgccgtagcttagccgcttcatcagccgcctgctcgaccgtcattgtgttgggtttgtccgccatcagccagtcctcctaactagtcctgtactttttggattggtgcgaatgctgctaacaaccgcttgataccttctgatttgaaagcaatgtccagttcagcatcttcacctgcaccagtaactttcacgaccgttccggttccccacttacgatgcttgactttatcaccgatcgaccaactattcttgtcagcgccggtaccactggccttcttgaccgtggcgcgtgtgccaaccgggttcttcttatatgaaggtgtaaaggcgcgtcgttcacgatctgccccaaatggcactttgggaccagtgctgcttgcaccatccagcgtattctcattcttaagcagctctggttcgatttcttcaacgaaacgtgaagccgggttattttgccgccgaccatatagcatccgtgagtacgcattggtcaagtatagcttcttctcggcccgtgtaattcccacgtaagctagtcgccgttcttcttccagctcatcttcgtccatcatcgcccgggatagtgggaaaattccttcttccatcccaatcaagaaaacgacagggaattcaagccccttcgctgcatgtaacgtcatcaacgtcacggcttggggttcttcttcgacgttatcaacatccgaaactagcgctaagtcagctaaaaagtccacgaacttatcactatcttcatcttcaggttgataactatcatcgaattgcttggtcacagacaagaattcttcgatgttttcgatgcgggcctgtgcttccaacgacttcgtagctttggcatccttcaacgccttcatgtagcccgtacgatccagaatttcctgcgttagatccgtcacggataagtattctcgcatcgcacgcaattcgttcattgtcgccgcaaacttcgctaacgcacccttggcccgtgcagaaataccattggccatgtcaacgttgctggctgcttccaacatggagtagccggcttcatccgcgaacaaccgcaatttttcaacactggtttgcccgatgccccgcttaggctcgttaacgacccgttcgaagttcattgaatcttgatcattaactgccaaagtcaggtacgataagacgtcccgaatttctttacggtcatagaacttattaccaccgaccatcgtataagggatattcgccttaacgagtgattcttccattacccgggactgcgcgttcgtccggtagagaattgcaaaatcgccgtaattcatcttatcccgttgcatgctctcttgaatcttagcgatgacaaagtgcgtttcgtcgctttcactctgaccacgataataggaaatcttgtcgcccggttcattttcagtccataacttcttgggccgccgagttgaattattgttaataaccgcgttggccgccgacaaaatagtcttggtcgaacgatagttttgttccaacatcaccgtgtcagcttgcggataatctttctcaaagtcgaggatgttctccatgttggcaccccgccaaccatagatcgattgatccgcatccccaaccacacataaattcttatacttgtcagctaacaggttaactaacgtatactgtgcgttattggtatcttgatattcatcgacgtgaatataatggaatttattttggtaccacgctaacgtttccgggttctgtttgaataactggatcgtcagcatgatcaaatcgtcaaaatcaacggcttggtccgcggctaattcacgttggtactgcaaataaacgtctgccacgatgctctcaaaggggctggcagccgattctttatacatctctggtgtttgtaaatcatttttggcatttgaaattgcggacaagattgaccgcggatcaaactttttcgaatcaatgttttgttccgtcaagattcgtttaactaaggtccgctgttcactggtaccggcgattgtgaacgcccggttgtacccgatttgttcaatatcgcgccgtaaaattcgaacacagagggcatggaacgttgagacccagacctcctgcgccgattcacctaacaacttgccgacccgttcacgcatttcacgtgcggccttgttcgtaaacgtaatcgctaaaacattccaagggttgaccccttgttcttcgattaaataagctacccggtgcgtcaatacacgggtcttccccgaacccgcaccggccataattagtagcggtccttctgtgtctaaaacggcttcctgttgcttgtcattcattcctgccaataggctttctttcgacacgcttgttcgccaccctttctaaaaatcagtcaccaaacattatagcaaattttgaccgtgattgctgtactttaaggtcagcatcgctcacaaaaatcacgactttgccatcgtcagtgacacccctattaattttacaacatctcccatacacggaaaacggattgaccaaaatattgcagaactttaacgaatgttgccagcccgcctgatggtcaccggcaagacccctgacaactatgcaacgtttatccgtatagccgctcaccgcaaagcggccttcattgcttgcttacccgaatcaaaccaagcgttaaaaaaatccaattcacaaatgaattggatttttaacttgatccggacaggtcagccgacttgtcagtcgtcctgaaccggcgtattcaattgaccgtaacgcgaccaagccgtcgcttcgaatcagacgttactcgtccgctgcatcactgtctgctggcgtcgtttggctaaactgccagatgctagtgtcttcaatctgttccagggcttctttgacgctcggtgcctcgaccagcacgtgaccggcggcaggcgcacggtgcgcttgtagcaatgtccggtgatagaagttgaagaaccagttggtcttgatctgccactgagtccgaatgccactctcctgagcaggcgtgaagtaagcggccaccactggcatcaattgcttaactggcatcaacggtagtcccgcgattgcccgcaagtgttgctctgccatactgatattcgtggcgcgttcgaagacgtaacccgcttgatgcatcgctggcacgatccgcttaacatacaaattgccgctcttcgtgaggaagaaggccacttcaaaaacccccgtataactcaaattatcgctaatttctttcgtaatccgccgcatttcgtcattcacggccgaatcaatttgggctggcacgatcgaagcaaccagctcatgattacgataacggttctcaacagttgggaaaaatgccgtcgtgtcaccactcttagcaccaaacacggagagttccttgtcatatgggatcagtgattctaacaaatatgtgccccaatccaacaaatcagccgctttgacaatatctgtctgcgtcttaatgaccagctgccggttttgacccaagcccttttgaatcggcttcaagatgcttggataaccaattgacccaatggattgatagacatcgtctaagctaacaatcgtcgctgacggagcgacattcaagttgagctgactgaaaaatgcccgttccaatgagcggtcttgcgtaatttccagcgcatcggcgccttgaggtacccgagtatgggccgccaagaaattaatcaccgacgcatcaatggtttccgactcgtaagtcaccatatcgcagcgttctgcaaaattctgtaattgttgttggtcattgagggccccgacaacgcgaaaatctgccagttccatggtctcagtattttcgttatcgccgtataccccgacattgatgccagcattacgcgcggcaattactaatccaacaccattagtactacttccaataatgccaagcgtaccacctgggtttaaaatcgagttgtccacttcagtccctactttcctatgctttaaataattataatctgattattgaattatttttaacgcgcattattctgtaacaatcatacttgctgacacgcacggttgcaagtttatcactgcttttttcggcgagcattacggcgcttaactcgcttgagccaaaaaccaccggaaatgtagcgcggttcgtacgcaatcacaaacgcattgggggccgcgtctttgatcaagccatacagccggcgttcattcttgcgcggcgccaaaatttctaattctaaccgctcaccttcgagaccatacgcggcgtgttgtgtgaccccaaagccattttcacgaagcacgcccggcaacgacgacttgggatcaggcaggattaccgaaatcatcgtgtagccaagtgccaaccgatcttcaatcgccatcccaacgtacacaccgacaccgtaacctaacgcgtatacgaccaaattaatcggattattgaggcgatttaagaccagcgataacccgaggacataaatcgtgatttcaataacactcgcaaacgcggcgaagtaccgataaccccgcattacgagcaaaaagcgtacggtgttcaacgtaatgtaagcaaagttgatgacaaaaataaggactaacatccccatatcaatgtgcatcataattccctcgctttcttaacttaagcctgggtgtcctccgaagcaaagtgcacccgatcaccatcaaatgacgtaatctgtgctaatgattctaaacggacgccgcgatcagcaatcaattgatgacccgtttggaagactttttcaatcacaataccgacgcctgcaatcttgacgtgagccttgtcgcagatttcaaacatcccttgaaccgcctgaccattggccaaaaagtcgtcaattaacaacacttggtcatccgcttgtaagaacttctttgcaatcgagatgtgattagacgtcttcttcgtgtaagaataaacttcagctgtgtataaatcatcaattaacgtgaccgacttatgcttacgtgcgaacacaacgggcacgtgcattgctaaccccgccatcactgccggcgcaattcctgatgattcaaccgtcaagatcttcgtcacacccgcatcttgaaacaagtgagcgaattccgttcccatggcaaacatcaggtcaggatcaacttggtgattcaaaaagccgtccactttcaatacttcaccgggaaggacccggccatctttcaaaatgcgttcttcaagttctcgcatagtaccctcctagaattataagcgacattaaaatactgccattaatttcattactttctatcataccgttgtaagtcatatttttgaataatattaattaatttttgtgcataacttggatcagtcgcatacccggccgtctgcaatgcttgtgcagccgtctgataatccgttgccttaatcaccgcagcgtagtgctgcgaatcccatgtcgtcccgtacgccaacttcttggcatgatcgaccagtgaagcatgccagctatcataaacagcgaagcggcgtttgaccgtatgataggccccatcataatactcttgcgtcgtcattaaccgccccgatgcggacttgacaccaaacagattattattctccgtcgcattggtactcttcccccagtccgactccaaaatcgcctgactcagcgtaatactcgccaacacgtgatattgttgatcaagctgttgcgcagctggcgctagctttttgataaacgccgtatgcgttgtcgtcggcgccgtcgccgtaacccgtgacttaaccgcccaattatgctgaatataccaaaccatcccaatcatcgccgcaagcactaacaagatattgacccactgaaggcggcccttcttcacgaataattgtgaccttgcacgttgcttccgccgtatccttcgccgcttacccgccatcacagccgcctcctttctggtcatcgcattacaaccctgtttagttggattgttgttcgtcagccggtgcgcgtcctattccgacctccggggctgggtgacaattgctggaacgtaagccgacgtcgatttgagctaacgcacaacccgcgttatctcaaatacgagtcttattctaagccggaagaaaatcacttccagctaagaataatttggctactgagcattgtcacccagcccctccagtctctagagtgtgaggggccacgggttgaagctgagcattgcctagccaacggattaatgcggtcttagcattcgtccgttggcgtagcaagcacaggcttcagtggcaccgagcacgtttcgggaacccgctcgaatggctgatgaacggccacttaacttggtacaattggtcgttgactattttgataatagaactttaaacaaagggtcaggatgcataagtcactttgtcaggagtttcaatcttattattataattcagagttggcgagctatcttaatattactttcagtctgacagttgattgataaaattaccgttttatgaagaacaacgactaattcatcaaaagtcgggtacatctccgtctgccattcgaataccatcccgactggaaggcgtttctgacaatgcccagtggtgaaatttcacttagcaagcgtcttgtgcttggttagtgaaaggccagtatttaagacgtgggcttcggcttaaatctgtgcccaccacgttccggcaattggcagaaatgcctggaagtcggcgtaggacgaaccaaccaaaaaagtttacgctaactcgaactgtttccagcgggcctaagctggttgcttttgccctaagaaatcagcatctaagtcttaatcgcaatgagcgtcggtcgtattacactctattttaccgacttttgaattaattttacatgattatcggacgccaattccttatttttttgctaaaatgtaagtggtcacattcgattaatccgaggaggaaacattaatgtcgaaaacttatcgctgggccattgttggtcttggtaacatcgcacacagtttcgttaaatattttgatcaaccggacggcgagatctacgccgtttgctcacgttcgcaggaaaaagccagtgcctttgctgctgaacatggtattccgaaagcctatgggaatttggacgatctgctagctgatgaacaggttgacatcgtttacgtggcaacaccccataactatcacatcgatacgattttgcccgctttacgcgcaggtaaacacgtcctcagtgaaaaagccatcacgatgtctagtaccccactcgcgattgccaaggaagtggctgctagcaaccaccttatcttagcggaagcgatgaccctctatcacatgccattatacgagaagctccacgattttgcggctgaacggcatcttggtgatttgaagatgattcaagctagctttggtagttttaaagaaccagacccaactaatcgcttctttaatccggaccttgccggtggggccttactggacattggtgtctatgccctagccttcgtggaagaattcttgactgctaaaccatacattactggaacgacgatgcaccgcttcagcagtggcgtcgacgaatcatcaacgattacgttgcggaatgccaatgatgaattagccaccgttgccctaacattccgggccaagatgcctaaacgtgggatcgtcgcgtatgagaatggttactttaccgtcgatacctacccacgtgctgacagtgccactttcactgacagcgaaggtcatactgagaccatcacggctggcgatagtaccaacgccatgaattacgaaattgctgacatgcaaaaaatggtcgctggtgaattgcacaacactagtctcgcaaaaacgactgacgtgatggatattatgaccgccgcgcgggcgcaatgggactttcgctatccatttgaaaactagtccttcataatattttctataaattagaacagcttgactaccggtgtgttgcgtcaccgatactcaagctgtttttatcgtgcaatattgtttaattagaccaatccacaaaaccagaatcggccagcccctggcaaaaatctgattgacctcaatgtgatgagtagaccaattataaactggccagtaattctgctaattgtggaaatcagaagactgcctgctggcatgcaagttgacacaggttacgggttggcctcggacgcacgctgatggatacatagccgactaattggtgtttgccaccacgccgttgtcattgattgcagaattagttaaaaatcaggcccaatcccataaagacaatgaatgagagacaaatcaacgttgcgtttttgattgaaatcgtgaaggtttcccgcttgacttgcttgtgcaggaagatgcgcgtgtttttccaaaccggaataatactgatcagcgttaataagctgaactttggtaacacgcccatgatgaccgcaatcaccaagcaagcatatccagccacgtaactccacgcgaatacctgaagcatcactggtttaccgagatagtacaaaatcgtatgccgaccgagcgcaatgtcttcgtccatatcacagatattatttgctaacataatgtttgaaattgcaaaaatggccagccccgacgcaattaaaacggcgaacgctgactgccacgtgatggccgccgtgtcatacgtattgataaagacggcaatccagaaaatcatgaagcccatcgtaaagcccgagaagaattccccgaatggtccctgtgagattggcttcggcccgccagcgtaaaagtaaccgaccgcataagaatagattcccatccatagtagtggcagccccgtctgcgtcactaaccatagtccgatgatcaacgagatgccagctaacccaaacgtaatcgtccgggcctgcccaatggaaatctggttcacgccaaccacgttagtctcttgcaaaaactcttgattatcgtcgttccgcggtgcgtgcaagaagtcttgataattatcattcgcattagtcgccatatgaaaaagagaagacgccacgaaaaatagcaataaatagcctagatgcaactgatgataattataataagcgtacatactccccaagacgaacggtaacacgctcgcaattaatgatttgatttcaacaaattcgagaaacacttttggtttcaatgatttacaccatccttttgtttgacaacgatacaagttatttgtacctttagtatagattgtattttagaatgtgactggctgcaagtgttgacgtcaaaacgtcccggggccatctctcaaaaaaagcggggtattttgattatgatgcaaacgatttggcaaccggaaagtcttgtcgcaaaagaattagcagcactaaagccgtatctagccactaacgtaaaaattgataacgccgccattaacgaccgcgttcacgaattgctcgctgcgggcggtaaatttttacgccccggcttcttttatctattcagtcaatttgggccggatcataacacggcgcggttgcgggcaggcgcagcagccatggaactgctccacgtggcaaccctgattcacgacgacgtgatcgatgaatcaccagaacgccgccacgtgacaaccatccaccaggactacgggcaacgtaacgccatctatgctggggacttgctcttcacctgctacttcgaccaagttttgattgcggccaagactcctgccgatataaaaatcaatacggcggcgatgcgggcaattctccaaggcgaattagatcaaatggcccataattttgatcccaccaccaccgtcgacgactacttagccatcgcccgtggcaaaacggcccgcttgttcagcctgagttgcgaacagggcgcccattttgcgggtgctgataccagcgtcgttaagttggcgcaacagattggtgaacggatgggcttggcctaccagatgttagatgacgtccttgattacgctggcgacgaggccttaacgcaaaagccagtacttaacgacttacgcgacggggtgtactccctaccgctcatctacgcgctgaccgccgaaccacaattagcagaacagttgccgcagccgggcgaccacattaacaacgaacaactactaacgattcgcgaccaggtgattgccttgggcggtgtcacccaggcacaacaattagccacccactacaccaaaaccgcattgaacctaatcgaccagctgccaactggcgaaacgcaacaaactttacggcgactagtaaccgagctactagtccgtaaccattaacacttattagatcagcgcattaaagtgccccattgactttgatgcgcgatttttttgcggccatgacacagttgataacgacacgctttgttcaaaaaaagttatccattttactaaaataaatagtattatagtgtttgtataaaagttgtaataacggggtctatttttcgtcaggaggagcttcatgaaaaagattgttaatcgcttgctggggagcgcactaatgattgcatcggtcacgatgctaagttcagtgtccgcaagcgccagtacttactatcaccgcacaccaacacgggcaacagcgcacaaagcctactatacgactgacaccaagtcgcataccttcagggctaatggcaattataatcggtggacattcagggccaatcatgatttgaaaaactatcgcaacacagtgtggacaacgagccagcaaaccgacattaccatgcacggcaagaaggttcgttactactgggttcgcaacagcaggaatggcgcctcgggctggatttggagtggctacttaaagccagttagggccaaagctaccaccccatccgaggcaaccctcgtctcaagaatgcgcgtggccaaaaaggcacagcaaatcgtgacggtcatccaaaacggctcatccacggctacccttaaactttggcaaaaaaccaatcgcggctggcagaacacactaacttccgcaagtcgcatcggcgccgctggcatcggtaattctcacgaaggcagcagtaccacacccaaaggcgtttatcacttaagcttcgcatttggtaaagctgccagtgccagaactagtggtatggcctatcgacagatcaaccggaaatcttactggattgaagatccacatgaccggcaatataacacgtggcagaatcgtaactgggccaataacaaaaacgagcatctgatcgattacacgaaggccgcgccccacaatcaataccaattagcaatcgtgatggacaatcacggtcaacgcaatggctcgggcttctttattcacgtcaagaatcaatgggcaacggctggttgcgtctcaatcaattacaatgatgtacggaccttactcagccgcttaggcacgaaagcctacgtggtcgacgttcagaatcgggcacaattacaaaattactaacaggttaaatcataacctggcgattaattgcatataaaaaggacttggtctcagcgactaagtcctttttacgctctaaattggcggtgtaatcagcaatggtcatcatgaccactacattcgtaggctgaatacccattcagcgcagtaattaaaagtctgtttcacaagcccaaggtgcacgtgaagactgctatcaaccagtttactgatcattcttgcgcatcatcacgcccttggtccaagtcataaaggcgtttaaaccgtggtgcgctcgcgtatagttcgctcggcgtaccggccatatcgaattgtccatcttccaagaaacgaacttggtcgacatggttgaccccggccaaatggtgcgtaacccacagaatcgtcttatcatgtaagacccggaacaccgtggtcagtaagtgggcctcagtaattggatcaagactgacagtcggttcatctaaaatgatgatgggcgcatcttgtaatagaatgcgggctagcgcgagccgttgtcgttcaccaccagagaaacgcgccccgccctcttcgacgaccgtctcgtaaccatcggggagcgtgtcgatcaagggtgctaactcgactgctgctagcgcggctttaacttgttcgtcagttgcttgcaagttacccatccgtacgttgttcataatcgtcgtattgaacaagtacggctgctggtccaggacaccaaatagttgagcgcgctcattctgtagccgtgcgatggggacatcattcaactgaaccgtcccactatccggtgtcaggtcacctaagatcagcttgagcaaggtactctttcccgttccggaaggtcctagcagggctaacttttcaccggcttttaaagtcagattcaaaccgtcaaaaatcgcgtgaccaccttccgcatatttaaagtcaaggtccgcaatacgcaatacttgaaatggctccgttaagactgtctgatcgtgttcatcttcaggcgtggtgtctaaggcgttgactcgtttgattgaccgttgataacttggccactcactaacaccctgactaacagactgcatggcatcaaccaacgggaatacggagaggacaaacgccgcaatccaattagaactagccgcattcgttgtccagtaaaaactactccagatcaagagcgctaaacaaatcaccccgaaaatgatctgaatcgtaaaatctcgccaccactgaaagcgatggtcctgtttacgaagtgccgcaattgcttcgataggctgggtttgccgctcatagaaatccgtttgacgtccggcaatcagccaatcaccgagccccatcaccgaatcagtcagctgcgtataaaagccctgttgaatctggcgactccgtgattcacgagcaccattcagtaagactgaccatagcggcattacaacaacgaccaatcctaacatcaacaacatcagtagtccgaaccaccagctaaagtaacctagaccaatcacaatcaccagtgtcatcaaccaggcaatcaccgttgggaaaacggtccgtaaatataaattttcaatatgatcgatatcgtcagctaaaatactgagaacgtcaccggtctgaaaattctggcgaatcgctacggcgtgcttggcaacggattggtacaacttcttacgaaagtctgatacgatccgcagtacccagttatgactcgtaattcgctccgcatagcgaaaggcgggccggccaatcccaaacgccctcgttagaacgattggcacataaatcatcagaatattatacgggtgtcgtgcggctttactgatcaagtagcccgagttgaacatcagcgctgaaccgcagaaaaatgtcattagacccaaaaacagcgtcagggctagtaactttttatacttgcgcaaatacggcatgacccaagtatcatttttaaaagttgccaaaaaatctttcattagatcgcacctaccatttcatcacgtaaccgaacgtacgccccgttatgcgcggccaattccgccggtgtcccttgttcaacgatttccccatgatccatcactaacacgtaatccatctgattaatccagtgtaaccggtgagtcgcgaagaaaactaagtgattatcaagtacaggtaaaatcgtcgttttcagttccgcttcagtttcaatatccaagtgggcagttggttcatcaaataacagaactcgccgcgagtcgtcaagaaaggcccgcgccaaagcaatccgttgcgcctgaccaccactgacaccacgggagccttcaccaatcgccgtatccaaccccgccggtaacgttgcaatccaggccgttaatccagcgttttcagcagctcgttcaatcgcttgccgggacgcatccggttgataaaaggcgatattctctgctaacgttgcatggaacagatatgggttttgcggaatgtagaaaaagctctgctgccaggcgtcctggctcaaatgcgagaccggttgcccgttgacttgaattttaccctgatcagcgaccggggttagaaagccacctaacaaattgatcaaagttgatttgccggagccggatgccccaataatcccgatccgttggtaaccatgcacatcaatattaatgtgttttaaggtcagctgatcatcatcatacttaaaatcaacgtcatgtaagcttaacgtactatcactttgccagtgcacaggctgagtaccgagctgttgacgttcagttggcaccggcaaagctagcatcttctggacatccgcaaacgcgttcttaccatttaaagtggcatggtagtcattagcgaatgttcgcaatggcaagaaatagtctggcgataagaccaggataaccagcgccggtagcaacgtaatcgtgccgttaatcaagccgaaacctaggaagaccgccacgaccgcaatcgataaggtcgtgaagaagtccaaagcgaaagtcgatagcatcgcaatcttgataaccgccatcgtttgcttccgataaccttcactgacctgatacacgttgtcagcgtaccgtttgctcagtcctaactgctttaatgtcggtaaaccgcgcagcgtatcaacgaagtgattagacatccgttggtagcccacgtactgcttatccgctttagcttgagcggcatagcccaaaataatcataaatagaataatcaatggaaaaattgctagtagaaaaagggcctcacgccaacgcaaccacgcgatgtaaattaaaatgatccacgggataaccatcatgtcgattactttaatcacaaccaacattaagtatgtctgaactttatcgataccttcaagcgctgtcgtcaccacgttaccagtcccagtcttagctacataacttgggccgagttggtataacttctgcatcactttacgccgcaagtcacccgtcgtctgttcgactaacgggtacatcacacgatttttaatgacgaccagtaactgccgtccgacccaagctaatgcgaaccatagcatgggctgactgatcgacgccaatgaatgcaagtgccatagtccaacaatcgccactgataggtagtaggcttgaaagacaatgcaaataccctcgataatggccagcaagcctagaatcgtggccgctcggcgcatccctggtagtttaaataatgccggatcaaacacatccgatccctccccgcttaaaatgaacggggtcgcaccctggcacttggccaaggtcgcgaccccgttggtgctgttaaattaattgtaccaccgcaccagtgatactgtcgtcatccgcatttgaattacgatgccaaccgtttgtagaagacccaataactccaaataaagtagatcaacataatcggcagtaccgataatgagataacggtcatcaggtgcaacgtatatggtgaattagacgcatctttaatcagaatgctgtatgccgaattgttcgccaccatgacgcgtggaaatagtccgttgaacaagaggacgaccacgtcgatcagtgagaggccactgctaataaatgagagccattcatgattcccataaacaccccaagtagccaataccgttaacgccactagggcgaccactaaaatcgtggttgagattggcttcttggtaaagaaatcggtgttaaagaacagtagaatcgcgaagactacttcaccggcaaacaggacccagtataacggtttggcccactgaagtgcccgttcacgcaacgtcccggtcgtcttcagccggataaagtttaacccgtgcaaatagcagagtaacgttacggcaaccccaccaacgattgagaacaagttcacgtagtcggtgaagtgggccgtcatatcaccattagcgttgattggcatccctttgaccaaagcggtaaacatcatcccgaacaggaaggcagcaaagaaactgccaagggctgcggcccattcccagaaattccggccggcgtcactttccatccgacttctaaattcaaatgagactccccgcataatgagggccactagaatcaacaacaagatgagatagaacccggagaataaggaagcataccacattgggaacgacgcaaacatcgccccaccagcagtgatcaaccacacttcattggcatcccagtgtgggccaatcgtatgaatcacaacatcgcgctcggcgcgggtctgggctaaactcttaatcgtcatcccaaccccgaagtcaaaaccttcaaggaagaagaagccactaaatagaacgcccaccagaataaaccataagaactgtagattactcatgactgaacgcctccttaccataaggatcgtatggtgcgtcatcgctagcttgcaacaaatcatcggggccttggtgtaaggcacgccgtgataaaacaatcatgacaatacctaagccactgaacaagcagaagtacacgatgttagaaaccagcaacgaagcgacactaacatttggtgaaacggcatccgcaatcgtcagtaacccataaacaacccatggataacgccctaattcagtaatcaaccagccggccgtgttggcggcgaatggtaagaacgtgcagattcctagtacccacaggaaccaacgttgccgctcgatcaacgttgactttgcacggttgaaatacagcccgataatggcaatcagggcgaagagtccaccagctactgtcatgacccggaagctccagaagagcgtcttcgttgggacgtagtagttcatgtccttgccaaacttcttgtcatacttggcatgaagttccttattaagggtattttgccccttcacgttaccggacaacttatgatagcttaaaatatccaaaacatacgggatttcaatcgaccaattggccttatggttcttagtatccatcccttcaataactgcccatgaagctggcgagccggaatccttgtataaaccttccgttgcggcaaacttcatcggttgttctttaatgatgtaacgcgtctgtaagtcacccatcccaattacaccgatggaagcaaccagaccaacgatcaaactaactttaatcgacttgcggaagaacgtgacgtttttctttttgagtaacgcaaacgccgccatccctgcaaccacgaatgagccggtcacaaacgccccgaacaacacgtgtggtaattcataccagagctgttcgttcttgacgactgcggcaaagctcgtcatctgtgcacgaccagttttggtattgatcatgaaaccaactggattttgcatgaaactgttcgctgctaaaatccacatcgcggaaatcatcgtcccaatcgacgttaaccagataaacgcacagtggagcttggcattaaaccgatcccaaccaaacatccataacccaatgaacgtggattccataaagaaggcaactaacgcttcaatcgctagtggcgccccaaaaatgtcacccataaaccgtgaataatcagaccagttcatcccaaattggaattcttgtataatccctgtcacgacaccaacggcaaagctaagtaagaaaatgcggccccaaaattgtgccatgtgcttgtacatgatgtcttttttgacaacatacaccgtttccatgatggcaacaaccaaggctaagccgattgataatggcacaaagaagaaatgaaacaccgtggtcatcgcgaactgaaagcgcgccaaggataaaatacttaatccaagattcataatggtcccccctttattaatttattccctacgaaagcggaaacactttattcacctttcataatagcaagtgataagtgaaatttcaatcaatctcaacttttattcccaaaatagtcaaagccgctaattttcaaggccactattaatacatttattcgtttgtaagttcacattttacaacttggcaactgccatcaaaatcgtgaacaatgctcatgattggcggacatagcagtctccaatcaatcagtcatcatggtcaaccagtccacaaagtgatttatattataaacaaatgatgctgttattaaaaaagcacttcatttaacaagtttaggccgcgaaaacgcaaacaagggcgggtcggcgtgctatattttacaacgtgcaatagaataaaacgttacgaggagtaaatataatgaaaaggaattcacaacaaacgaccaccgttgaacactacaagatgttcaaagatggcaaacattgggtttacgcggggattaccattgcggggctcggtagtacgttaatgctgacgactaacgccttagcagcaacgaccaccccaaccagtgccacgaccacttcggcggccaacgcccctgcaagtgttgctagccaactcagtcaagctgccggggcaacggtgactgattcaagcagccaggcgtctactgtcgccagtcaggacacactgtctaccgacagcaatgccggtactgagcctagtcaggctggaactactgagacaagtactaccggggccacaactgagactagcacgagcgaccaagctgcaagtacggcggctgaccaggctagcaaagcggccaacagcgccagcgacatgggaactagtcaggcgaccaccactgctaattcgacagcggctagtaccgttaacggtaccgaacaggcggctagcgaagcgacgaatgacagtacaacagccgcgaatccgactgaatcaacaactaattcagccagtgatgccacgaccgcttcaactgatgattcgactcccaaactagcgacaactgctagtgccagtactgactcgactgccgcggcaacgccaactagtgcggcagcgactagcgcggctagtgatgcgacaagcgacagcggtcacggtttgatctacgaaactaacgacaccaccggcaatcaaaagagcacggtcaccattacacaaagcggcccttacagtgtgacctggaaaaaggtcactacctctgataagaccgatacgacaacggtgacgttagatgccagtgatattgtggcggtcgtcaatacgatcaaggacttagcaaatcaagtggcgacaccgtctggccaagaacaattagcagcggccaaagcaaaactatcaacgattcttgacgcgttaaaagaacttcctacagatattgccagtacgatcgtgggtaacgtgctttacccgatcgtcttcaccggcacgggttcggaagccctctctaatttacgtaccgaaatgaatcagcaccgttacgacatttctaatacctggaccggtctcgatcccgtcgcttacgctgccgaccgagctgcggccgaagcgtattatccaacgaccgtaacttggtgggataacgtagctaaggagacttggaccctacctgaatacaatgacccgacacagtacgttcgtgcttactatattcaaaacggtgattccaccaagacagtcatcatcggccaaggttggacggaacacgttgattggatcggctacgtttcgaaaatttggtatgacatgggctataacgtcctcatgccgagccaacgtggccagttcctaagtgatggtgataacttaacgtttggttatcaggataaatatgactggttgaactgggtcaagatggtcgacgaacgcaatggtgctgacagtcaggttgtcttctatgggcaatcattaggcgccgacaccgtattggaagccgcctcagttcctggactttcaaagtccgttaaagcagttgtttcggacgccgggtacgcgaccttaccagaactaggtagctcactatacaacaaggccatcgctgccgtttcaaacgcccttcaatccgttggtctgccagccatcacgagcctgcccttcctatcctatgataagattgtggccgcaatgaatgctcggttgatcaaggagcaaggtttcagtgtcgatgacttatcagcgactgatgcggcaagcaaaatcaccattccattgctcttgatccacacgcaagacgacgcctttattccatatacgcaatcgttggaattagccgccgctaatcattccgctgaccaagaagtgtggatcttaccagggactgtcggtggtcacgctgcggccaataatgcgatcctgcaataccgtcaacatttgttagctttcttaacaccactactctccgtcgcggaagctgaagacgaagcggttgatgttgatcaagtaacggacgatcgtaatcaggaagcaactgataacgggacaagcaccgatacgaccacccaaggcaatgatgacgttactgatgacgttactaatggtagtcttgataatcacgatgccagcgattcgcaaaccacgacagcgaccggtgagctgacgactgacgatgccactagtcacaatcaaacggccagtgataatgcgacgacggacattactgatgcctttgatgacagcgcaacggatacgaccacgcatgcaaagactaacgagacttcaacgcctcatgacgttgacttaaatgacacggataatgcggtggatagtgatcccgacacggcggttgatgggacagacgttacgaccactacgactcgatccagtgataaccatcagaacggtgttatcaagggccaagccagtgattcaattatggtcagctcaaatgccacgaccaacacggactggttagtcaatcacgatgacagtggttcggccgtcacagccagtttgcttcaggattacagcgaccgtgaagcaagtgttacgacgccaaccaccgtatcagccacaacaactgatactgacagcgcggacctagttcccgtctcttcaccggctaccaaggcgacgactgcaacggctgatctcccccaaactgatgaaacgacgcagtcttggattgcaactttaggtgctagtctcctggccctagcaacgggaatctgggcccaaattcggcggcgctttagttagtcaacttttcccagtttcgttcagtggtgtgttattcttaataaaactatcgtgtgaaaagaggaatcactatggacattgggacacgagtgacgttcgttctggaaggtgagacttataccgggaccattgcgaagagttacactaattcgtatttgatctcctttacaagtcctgacccagccatcgttgataagtatcacaacaaagtcattattagccagaaacaagttcaagccgctaaatagcggttaaaaacagccactcttgaaattcgcgaattttaagagtggctgtttttagtttgccctgctttaagttgtcactttagtaaatcattttttaaaacgtagtagcggtgtcccaatcagtggtgtgagaattccggctaaaatcgcttctggaatcccattcgaggccacgatcgtcaacaagtacggcattagtttactcaagttaacttgataaaatccagccgcttggtggctgtagagtagcccaatcaagcccaaaactagaatcgtattcgttaatgctccggccacaccagcgagcgtcatccctaacactttttgatgtcgtttttggaaccacataaaaatccaaccggctatcaaaccgacaagaatccgcggtaccaccgctatcaacgggttggtgaatacgattggcgccaagggactcgtcggtgcgacgaacgcccgtatccacgcaataagtccccaagttccaccaataattgccccgtcacgtggtcccaagaccacggcggccaagataaccgtcacgtgaattgtcgtaatactcaatcctggtaatggaatgtacccaaaaaacggcacgatattctgaatgatcacgattgccattagtaccgctaatacactgatatgataggcgtttgaacgtctctgcatcatcagccacctcaactctctttaccttatgaattatgcgcttaattatagcatatcccaaagcttagtagccgcaaaaaagtggccctcacccgaccggtaagacccacttttgattacgatttcgattctttgacacgtagccccgctcgaatacgggagtgccgataactataggcaaagtaaatcacgataccaataaccagccaaataccaaacatatgccacgtaaatgcctgtagattaagcatcaggtagatacatgccagaaatgagacaactggtaataccggataaaatggtactttaaatgaactattgatttgttgtagcgtttcgtgtcgacgcaggaacaccacgccaattgagaccatagcgaatgcgaatagcgttccaatattgactaactccgcgattttatctaatggaatcacagccgcaaatacactggcaataataccaaaaatccaagtactcttaaccggcactttggtatggggactgacggtccgaaagactttcggtaacaacccatcccggctaatcgcaaacagtaaccgggtcccaccatataacatgacaatcaagacggtcgtcataccgacaacagcacctagtgacacgattcccgccgcccagttttgatgaatgacggctaaggcatacgccacgggatcacccacgttaagcttgctgtaatggacgaccccgaccagaaccgcagccatcgccacgtacaaaatcgatgccacaactaaggaaccgacgattccgattggcatattacgcttaggatttttcacttcttctgaggcggtcgacaccgcatcaaacccaatatacgcgtagaatgctaacgacgcgcctttgaccagtccgctaacaccatggggcatgaacggatgataattggcaggtttcacaaagaaaattgccacgccaatgaaaagaacaatcactagaatcttaacgattaccataattgaattgacccgggtcgactcttggagcccgccgaccaataacagtgagacggccaagaccacgacaaaggcaattaagttgaatccagcaccactgacaccggcagtaccagcggcagcggtcagaaatgttggtagtttcagcccaaagccactgattaaattctgaaagtacgatgaccaactgacggccactgaggataccgcgaataaatactctgagatcagagaccaaccaagaatccaggctaagaattccccaaaaacggtataaacgtaagtataggcactccccgccaagggaatggtcgaagaaaattcagcgtaacataaagcggccagtgaacagaccaccgcagcaatcacaaatgagagcatggcagctggaccggcatacttagcggcaatgattccgggggtgataaagatcccagaaccgacgattgccccgacacccatcatcgttagactaaatgcactcaacgtcttctcgaggccgcccttattaaaattagctggattgactgatttcttaaccaacaatcgttgtgatgctttcatctggtacgcctcctaatcaaaatcttaataatgcaacgttgttaattctattaatttttgtgcaattagtcaagtaaatctaacaatttcagttaattcataatcaaatccggtcaagacagcgttttacgtcattagtcattttaaacaaatttattaataattcataagatttgttaattttaatctaaccaccctattactggtcactggttatcattgttttattcatccagttgctgccgtgtccggcgaccatctcagactgacgttgcacgctaacacattaggcggtcagtcggttgctaagggtcctgctcgccaagaactattcattgaccgaccttgagcttggtttttgacggttcaacctgcaagcactccgagtctcactcacctaactgtgccagtctcggtgcgccatttctcaccaccctaattgcaaacaaaaaaagaagcattccgtctctctcaaccggaatgcttctaaataagctttagatatattgaatcaaggtcatcaagactggcacaactacgatgaacaacacggtactcgttgtcacgatgttagtggcgtattccacgtcaccatgtgcttcgttcgccaagattggtagcacagctagcattggcgttgctgattgaacgatcaatgtttgcgatgctaaggttgggaagctagcaccgaggttaccagcaaccatcaagacaagaatcatgatgactggtgacaagatgaagcgaccaatcaacgcaacgatcgtatcacggtcgaaacgaatactcttcagaccagcgtcggccaacacgatcccgatgtagatcaaggaaagtggcgttaccaagttcccaacgtaagtcaacgttgaactaacgaatgataccttcatgattggaatatttagcagtaagaaaattaatgcaactaagaaaccaaccaatggcattggaatgactttcttccaatcaatcttgttatgcgtcttttccttggatttcgtcgggtcgtcgtttgaaatcaagaagaccccgaatgcccatgtcgaaacggtattaacaatatagtaaacaaggaaatacgtcatactcttgtcaccgaacaacgcaatgttcaaaggtaacccaatgaaaatcgtgttggcgttgacgatcgcattgatgaaaatccccttacgacctggacggacccgcataattttaactagcgcaaaggcaatcaagtagccaataatcacggctagaaaggcgtaagccaagtaacctgcaaatgatcctaattgcccacgagttagtcggctcagcacagatacgaaaatcgatgctggcaaagcgatatttttgataaatttggaaattgttccagcaaacttatcatcaaaccaacctgctcgtcgtaggacgaaacctaatatcatgatcaaaacgacaactaagacgctttgaattgaattccataaaactcccatgtgctcttataccctcttacaattctcttattttaccgacactatttgctgatggcccggtattctgggacccacttcatatcagcaaccgcttgtttagcatctgcaattggttctttgttgagcttctgatcgataacactttgtgccacgacttcagctaatttttgtgaaaattcagtaattttcgcaactggtggcaatactgcggcacccggcttcgacgtatcaacgattccacctaatgcgtggcaggctgctgacaaggtttcagcgttcagcaccttggctgttgaagcaatcaaaccaaatcctaaaccagggtacatcaaggcgttgtttccttgaccgatttggtaagtgacacctttgtattcaacatcatcagctggaatcccagtcgcaactaaggcccggccgtcagtccatttgattaagtcttccgctttagcttccgctaacttggttgggttagaaagtgggaagatgattggccgttccgtgtgcgccgccatttccttaatgatgctttcagtaaaggtaccaggctgagtcgatgtcccaatcataacggttgggtgaacggctttaacaacggcttccaagttggttaattcgtcggcgttgctaaattcactccgtttgcgcgtgaaggctttttgggctggggttaaaccttccgtgtcgtcaaatagtaaaccttgcttatcaacagcgtagaagtgttgtttagcttcttcttctgttaaaccagcttgcatcaattcatccaagatttggttggcaattcccataccggccgttccggcaccaaatgataagattttttggtccttgatgctttcctttgaaatgttcaatgcgcctaagataccagctaaaacaaccatcccggttccttggatatcatcgttaaaggttgcgatttgatccttgtacttgtccaagattacttgagcattgtcgcgaccgaaatcttcaaagtgtaacaatgaatctgggaataattgttgttcagcagcaacgaacttgtcgatcacatcatagtattgttcgccggaaacacgcttgtgccggttaccaagatacaatggatcatctaataatttctggttgtttgttccagcatcgatgctaactggcagtacttgtgatgggtcaatgccggcagcggcggtgtaaaccattaatttaccaatggcaatatcaacaccgttaacaccccagtcacccataccaagaataccttcagcatccgtaacaacgactaaccgaatatcacggccgtccgctgcattcttcaaagttgcttcaatatcttcaggtgcatctacggaaacaaaggccgcattttgtgggtccaagaacaattcattatattgttcaatggaatcggcaacgacgggatcataaacgattggcataaattcaaccacgtgttcatccatcaaatggaagaatagtgtccggttttcgttaaagagattcattaagaaaatccgttgttccaaacgactaggcttgctcttgaattgggcataagcttgcgtcgcctgttcatcaattgtttgaaccttgcttggtaacgtccccgtcaagccaagtgcttgacgttcctctttggtaaaggcagtgcctttatttaagaatgggttatttaaaatttcacttgcagtttttgtcattactgcggcctcctaattaatttacattttcatcaattttcattgctaggaaaaacgtcctatcaatttacaagtaatactgtaacgccagtaaaatgttatagtcaaaactatgatatgatataaatatattaaataaggtcgctacaaaagctgatttagaaaggaataaaaatgaacacaaaagacttagcttatttcgatgaattaatttctcaaaaaaatttttcaaaagttgcgaaaacattcggtgtgagccaaccaactgtgaccaccgcaatcaaacgcctggagtctgaattcggggcaccactcgtgattcgtgaccgtgttaaaaatacgttacacgtcactgctagcggggcgcaacttgctgaacacgctaaaatcgttttacatgagttacgcctcgcccaccaagaaatcgacaatctatcccaaaatcgactgattttaggattaccgccaattattgaaaaccattattttccaaaaatcggtgcccgattggccgcggaagggctattagccggtctcgaaaccattgaggggggctcgatctggctacgtaacgctgtgcgggacggtcgcgttgacatgaccctgcttggttcggtggagccgctcgcttaccaaacgttgattgccgaagaatttgaccgtcagcccttctgtatctacgtgtccaaacaacatccgttagcacaacgtaaacgggtctactttaacgaactacgacgtgaaaaatttgttttctttaatagtaatttcatccataatacggccttcaacaaactcacgcgccggaatcactttcgccccaacatcgtctttcgttccaacgatacccacgttttaatgaaattaattggtgaaaatgtcggcatcggtttctttaccaaaatcgtcgatcactaccgtactgacgtcgtacgactggaattgatggacattgaaccccctgaatttatcacaagcatcgtctaccgaacaacccatattctgacccccgtgcagcaacagctactgaccattttgcacgaaacattagcggttgacgctgatcagaccgattaagcaaaactgcaccacccttacagaatagtctgtgagggtggtgcagttttcgtaatcattacaaattgcaatatatccaaatgaaacaatcgtgaagacacgtcaatctcaaagtaaaagttgaaccactcaaggaatcgtgctgttcacttagacagatggctcagtcgcgacgtttaaatcttcattttaagtaattgatcaataaaccgttgttcatcagtggttggtaagtacccggcccgtgtgaccaccgagatattgaagctgaccggcaattgatctttgatctccaaacatacgacgccatcatccgctttaaccacatcacgaaccagtaagctaatgcccaagttggctttaactaaggctttgacccatgagatatcgggggtccggtagataacttctggatgtaccccggcaaagtcacaataggctcggaaggcttgtgggtgcacgtatttgccatccaatccaatgaactgtgcctgaccgagattcttaaaactaacggcggcttgtttcgccaaactattttgaggactcacgataatactgaatggccgtgcccctaagtgaaccgcacgaactgtcggcaaatcaaatggtaagtaggaccctaataacgcgatgttgatctcaccatgcactaacttacgcaatagctcatctgagcccgtttccgttatttttaactgttgcagtaacccgttctgaagtaacttttccgcaatttgagggaaatataaagtgccaataattggtggtaagccaaaacgaatatcagtctgtaacgtactctgaatttcgcgatgagcaagttgcaaactggcctggatctggcgtgcattcttgtaaagcagctgaccggcccgggtaatatttgtctgttgatggcgacggtcttgaatcaccagtttgactgcaaactctttttccaaccgatgaattgcttgagtcactgccggttgtgagaccgcaaactgcttggcgaccatcgtataattttggcaatcaactaacgcccgaaaataatctaaatcacgtgtattcatccgcgctcaccaaattccttcatgtacatcgccgcaatcttttgctgtagctcagccactgaatgccgccgtgaacgcgcgcaatccttggcttcacggtgacataataagcaacgacgcttcggcagccccaaatccgtccgcgacagcgcgcgctgtgaacccgcttgtaagatgtcaatatcatataagcgacctaacggatcgtgttcttcaaaagcgaccgccagccgtttgctagtcgcaaagtcagtcgtcagaatcaagaaccgctcattacccgccggatgattccaatcagctgccaccgtgtatgtcgacaactcagcttcaaaccgctggacaccggccaaaaacaaccgtcgtagtgcagcgttattcttaatcggtcccggaatattcaacttgattgccgcaatcgtggcccgggggttagtcgctgtcaactgttgctgatacgcgacccgttgatcacgggctgctagcattgccgtgattgtttgcggttcaccggttgtaaaaatcgtcgccatgcttgtcactttcttcctatatatttgttatatttccagcttaaccgaaattagtcgatttttaaactaatttctttggtctctaactacagcccaaatcaaaaatagcccacgcaccgattactcaagcgcatggactattgatttgggttagtcaaaataacttattgtaaatatttgaacatttgttgtccggcttgccggccaaagattaccgtttcagcgattgaattaccaccaatccggttattgccgtggagaccgccgaccacttcaccggctgcaaacaggccggcaatcggtcgttcgtcctgattcaacacttgggttgctggattaatggcaatcccacccatcgtgtagtgaacagctggcgcaatgtgaattgagtagaacggtcccgccgcaatatcgcgatccatcccagtcgtccggttaaaggccgcatcattatggttagcgactgcctgattccagtcagccaccgtctgtttaagcgtcgcagcgtctaagccggtctcagtcgcgagtgtttccagatcagcaccagtctttaccaggccaatgtgatcgtaaaattcaaccgccttgacccggtcacgaatgccgcggtcaaagatcaagtaagcaccagtaccacccagttgatcgatggcagccgtcacgttcttacgggtgtcgagttcattgacgaaacgagccccttgattattgaccaaaatcgcaccttcgccccgaaccgcttcaccgattaaataagcgtgatccgtatcctgttggaccgttggatgaacttggacttgatccatatcgaccaacttagccccaacagcttgcgctaacagaatcccgtcaccggtcgcacccggctgattggtcgtctgataatttttaaggtcatcacgatactggcctaatagggccttattcgcaccgaagccaccggttgctaacaagacggctccagccgtaatcgtgacagcgccatccggagtcgttgccttaacaccactgatcttgccggcttcgacgattagctcatcgactttgacatccgtgaagagtggtaactgagcagctgcgacctgtttcaacaactcagtgactaagaaaccaccaattggggccattgaactcggccgatgggtccgcatgacgctcatcccaccagtaatcgtcaaatcgtccaacttaataccgtggtctgctaaccagtcaattgcgagcgcactgtgttccgtgaagaatttcaacaatgcttggttattcatgccgccgccacctttaagggtctcgccgtagaaatcaccaaagctatcaacaatatgatgatgcaattggacgttggtttccgccgcattcataccagatgaagcccgggtggtgttaccaccgattttcggcattttttctaaaataaccgggttcagccccagttcgtgggcctggatggccgccgtcaaaccagcgccccccgatccaatgatcactacgtcatagttcggttttaaatccgctaatgcggttggtgtaaatgtaaacttttcagccattaattgccacttctcctctcaattcgaccgggggtattccccagtatggaaccaaaatctaatttattattgtcattaactggacacgggccaccattccaagtctaggaacaatgacccgcgccacgttgatccgcgtcagtagttcaacacacgatcaatccttattttagcttaatcatcaatattcgtcatatccagtggaaccatccattcatcgaattgttccgccgtgactttgccggacttgatggctgcttcacgcaatgttgtccccgctttttcagctgcttgagcaatcattgcactgtcatggtagccgatgtgtggtgacaatgccgtaaccgtcatcaaggaactgtcgactaattctgccatccggtcttggttgaccgtcaaacctgcaatcatccggtcagtgaagccggtaatcgttccagctaacaattcagcagattcaaggaaggcatcgatcaaaacggtcttgtaaacgttcatttcaaaattaccttggctagaagctaaatcgacgaccacgtcattccccataactcgtaccgctgccatcgtgatggcttcagcttgggttgggttaactttcccaggcatgattgatgagccgggttcgttagccggaatgtttaattcgtcataaccggcccgtggaccactggccaagaaccgcacgtcattggcaatcttcatcagatcagccgctaaggtcttgatggccccgtgaaccacgttcaagccagaatgatgagccagaccatagaacttattggaatcagccgtaaattcaattccatacaatttgctcatcgccgcagcaatgttttcagcaaaatgaggggcagcgtttagaccagtcccaacggcggtcccacccatggcaagctcgcctaacgttggattcaactgttttaagtaggcaatatcatgttcaatcgcactggcccaaccactcacttcttggccaaaagttaatggcgttgcatcttgaagatgggtccggccgatctttactacccgccagtacttcttttgtttgagcttcaattccgctaataagtgttccgctgcggcaatcagcttatccacggcaacggcggccgtaatgttcatcgccgtcgggaagatatcgttggagctttgaccatggttgacatcgtcgttcggcaagatttcaatatcaggattgatcttaccagccatgtgtgcgaccacttcattaacgttcatattcgtttgcgtccccgaaccagtttggtaaacaactagcggaaagtccttacgcaaatcttcatcgtcgagcgctaataacttatcaatggcagccacgattaaatcagctttttccgcagtcattgcttcaacttctttattcgcaatcgctgcggcccgcttaatttgaagtagtgctcgaatcatttccaacggcatcttcgtaccagttgggaagttatggcgactccgttctgtctgagcaccccataaggcgttcgcaggaattttaacttcgcctaaagtatctgattcaactcgatattctgtcatgttgataacctccaattaatgtgttggtaagcgcttactaagtgtgtgaaaaaaataacatttagtttataaacctagtttagcgcccccatatagctatagtcaaactcagttttagctataagtattaattatgaggttgatataacagtcgtttagcgttgaaagtttgcggtaactgtgtgtttgataaaaatgtttatttattcacatgttccaatttatttctgttgaccaattttactcgtaatcgtcatttttgattacttaatcggctcaaatatgccaaatcacaaaatagcgagtcatgattaaacgagaccaaaccagcttagacccgctggaaaaaattcgaattagggtaaatatgcttagccagttcgtcctacaccgacttccaggcatttctgccaattactggaacgcggtggacacagatttaagccgcaacccacgtcttaaatactggtcttccactaaccaagccagaaacgcttgctaagtggaatttcaccgctgagcattggcagaaacgccttccagtcggaacagtgttcgaatggcggacgaagatgtacccaacttttgatgaatttgtcattgtttttcataaacagtaattttgtcagtcaactgttaggtcgcaaagatattagggtagctcgctaattcggaattactataataataatagaacgcctcaacaaagtggttagggtaaccctaatgtctcgctcaaagttcccgtatcaaaatagccaacgaccaattgtacccagttaggtggccgttcatcagccattcggacgggttcccgactgtaggggctgggtgacaatgctcagtagccaaattattcttagtcggaagtgcctttcttccggcttagaataagactcgtatttgagatgacgcaggttgtgcgttagctcaaatcgacgtcggctgcgttccagcaattgtcacccagccccggaagtcggaataggacacacaccggctgacaaatagcatcgctaattaagactcactttcattataaaaccaaaattttgtcacacttgcaatagaactgccctgcttaactcatttcaattcaccataaataaaaatgacccagctagtcatcagccgggtcatttttgtcatcaatatcttttagtccttcaccgctttaatcgtatcaataatcgtgccatcgcgatattcaatcaaggcaacggtgcgatctgtaaattcaagtggttggggttggccgactttcttttcggctaattgttgtaattcttcaatcgtatagaccggcacacctgggacatgactgagtgctttaactaggtcctgacgccgcgggttgatggcaatcccgtattccgtcacaacaacgtcaatggagtcccccggcgtgacaacggttgttacttctggcacaatcgtcgctaaccgaccacggacaagtggtgcagagataatggtcagtttggccgtagccgcatcttgatgtccaccaatggcgccgcgaatcacaccatccgaaccagacatgacgttgacattaaagtgcgtatcaatttccaacgcactcagaatggcaacatccaattgatcaaccattgcgcctttattatcagggtcagcgtaccatgatgcgtcaatttcttgttgattaggattggcgtgcatcgatgctgccgcccctttgtcaaagtcttgaacatccatgactttgtcaactaacccttcttcaagcaaatcagtggttggtttcgtaataccaccaagtgcaaatgaggctttgatttgattatcaagcattgcttgccgcaagtaacgagtgacagctaacgcagcaccgccggaaccagtttggaatgagaagccgtttttaaagtatggtgagttcacgatcacatcattaacggtctgggcaatcttcaattcctttgggtccttggtgaagcgcgtcgcacctgaaccaatcttgtctgggtcaccaacttggtcgacctgcacgacgtaatcgacttgcgtctgtttaattgaggccggtgtatttggataagccacaatattatcggtcaataagacaacttggttggcgtattgcgcatccatcagggcgtaacctaaggaaccaaagactgctttaccggccatcccgttcgcatttcctagtcggtcagcattcggcacacctagaaaggccacatcaattttaatatcaccatgttcaatggcccgggcccgattaccatgagaacggaagattacggggttctttaaaccaccgtgtgaaacgaagtccccaagagagccccgcatccccgagctagtaatattcgtaatcgttccggccttaattgcttcgatcaccatatcgttcatcacgcccgttaaggaggatggcgccaaggtcaaatctttaataccggcatcaataatggcccgcatcacttgattgaagacgaaatccccattacgaaaatggtggtgaaatgaaatcgtcataccatctttgacagtggcttttaccacgtcagcaacggaatcaacgactttgttgtcccctgttgaaacgtgaactttgggggccacccgttgaatttcaggatgtccgatttcggttgactcaaaaccttggtaatttaacttcgtcattaattctgctggtaattcgcggtctacactatttttcaatgtaattgccctcctcgtcgagtaagttggaaactttggctaagctcatcacacgttgagcccgcaaaacaacgggccggtctaccatttggccattcatggaaataacaccagaacccttgatccgggcttcctcaatcgcggcgatgactttttgggccttaataacttcatccttggttggttcatagactgaattgaccattgcaatctgtcgagggttgaccaatgatttaccgtcaaatcctaattgatgaatatgccgcgtctcacggtagaagccatcgggatcggccatgtttgtaaagaccgtatcgaacgcggcaatgccagcagcacgagcggcgtgaagcaccatgttacgggcaaattccagttccgcgccatcaggataacggtgggtcttcatgtccgtcgtataatcttctgctgacaaggcaatcccaatcattcgatccgaggctgccgcgattgccggggcattaagcacgcccttagcgctttcaattgcagccatcaaatgagtcgtgccaactggtatcttaaattcagcttcagctgccgtgacatccttttccaacgtttggatcatggtagccgattcgacttttggcaaacggataacatcaatgccagccttgaccattgctttgacatcatcagcgtaatacttggtatccaaaccattgattcgaacgaccaattcagcgttgccataatcttgcgtttttaacgcttcgtaaaccagcacccgggccgcatccttttcagccattgagacggcatcttccaagtcaaacatgatcgagtctgcaccgtaaatcccggcatcctttaccatggctggattattaccaggtacaaacatcattgtccgccgtaagcgttcttcattttcagccattataatacctcccatgctggtgccgtggtttctaacgcccgttgtgctgccgtaatagtccgcgctttaatgacgcagtccaacgcccctttatcgacagcgcgcaccttcacattatcgatattcagttgttgaagcgtcgtcgtgatcacgtgcttgatttgcgccccaaactgtttgataacatccgattcaaggtcgatttgaatgccgttgtctcccgccattaacatgatctgaatatcagatgattccaaggttccggcgactgccgttgtcttaatttccatcaattttcattcctttctgaattcgcgcttgtaatgttgttaggttattttttataaactgggccgttgttgccggtaccagttggtttaactcagttaagttgccgctttgaatccgttgccgaacagtccgcgccgaaattggttgattagccaccgtcgttcgcgatatcactcgtacagcaactgccggtggtaattcacgctgcaaaactcggttataaatcgcagtcgtccgcgacgtcggttcactaccaacgaaccgggtcgtaatgtgcagtgctggtgcaagttgctgcttaaagatccgggcgtccaacatcgtctgcgcctcaattgcgctcgccgctgaatccaagaagtaggctggaaaggtcgctgcactcacgagatagtcctgcccgctgacgacccgaacgttggccaagtcggctgttccttgttgaaccagcttaacgcgctcggccgtacggaatagactcgcatctgtcgcaacgacgaagacgtaaactaaatcactgaccgccgcggcttgttccactaaatagcggtgtccccgcgtaaacgggttcgcattcatgacaatcgcgctgacacgctgttgtgcttggttgggaatcatcggcaactgtttgacaaaatccgtcatatccggtgcgccgttttctaatacggccgcttcatccgaatgagctaattctttaaagcctacgtgttgaaaactcgctgaatacttggccttggtaaataccatcatatgaaagatctgtgcttgaaacagccgattgaccagtgcactcacgatttgattaaaccgggcccccggctgactattcttattacagacacccacatatttaagcacgttgccagctaacgatccggtcccaacaagttggccatcctcgatcaatcctaaggtcacatcaatatgttcaacctcttgcgggctaaaattagtaatccctaatgacgttaagaattgttgccactgggcatgctcgtgcggattatttaattgcatttcaacaacttgcgctgccatcagacaacctcctatgattaatgctgtgcttgcgcgtacgctgcaacggccgccgtcacgttcggtaccacttgtgaatcaaagacgctcggcacaatcgtcgtcgcagttgagttcgacacggtcttagccaaagcctgagccacttgggtctgcaacgcattatcaacttgcttgaccccatttgtgagtaagcccttgaagagccccgggaaagccagaatattattgacctgatttggatactggctagaacctgttgcaatgactgtggccccagccttctcagctactgctggatcgatttctggcactggattagcgagtgcaaagacgattggatcatgattcatcaagtggacggcccctgctgataagacgttggcgtctgacaagccaatgaagacgtcctggtcggccatgatcttcgccagtggttgcccctttagttgtacaggtgttcccaactgtttggcaagattccgttgatactggttgtaccgctgatcatccgctgtaacgaccccgtaaacatcgaccaaggtcagttgtttgacaccgaccgctgctaataaccgagctgtagctaacccggatgcgccgacgccgttgacaacgatgcgcatctgccgtaaggacttaccgactacgtgagcggcattgatcagtcccgccaacacgacaattgcggtgccttcctgatcgtcatgataaaccggaatatcaagctcatctttcaaggccgcttctagttcaaaacacttaggcgccgtaatatcttccagatgaatgcccgcaaatgagagcgacatgtttttgattgtcgccaccattgctggcacgctgacctgatttaacgccagcggaatcgcattaatccctgcgaggttcttgtataggagtgccttaccttctacgaccggcaaaccacccgcgggaccaatattgccgaggcccagtactgctgacccatccgtgatcaacgctactaatttaccactcatcgtgtattttgcctttaattccggatgcgccgcaatcagcttggaaatcaccgcaacaccaggtgtatatgctttacctaaatcagccttatcggtcactgcaaggtctgaatgaatgtccaaaacccccgtatgggcggcgtgcaactttaaaatctcatcttgttctaccatcaatatctgccttctcttctcaaaataataccgttcactttgttatccccagtgtacgaccattttttaaaaatatcaaatttagattggatttttataatttttaaaaagtcagcttttctggtataataaacttaaaatattataaacgagttttaaaattttaaatcttaggttgataaagaggtcatcgatatggacgatatgaatcatcgccgcctgttgattggaattgcacatgattattacttatccaaaatcaacatcgctgaaatttcaaagaaataccaagtcagtcgttatctaatttcaaaatacttagacgaagccatggcaaccggcctagtcaaaattaacattaacacccccatcgaacgaaatagtgagctggaggctaaatttaagcatcgttttccaattgaacatatttatattatcaaagacgcggataccacgagtgacgatgaacgccacgtcatcgagtttgccgctgaaacgattcagcgccagattcttcaaagtaaagtgattggcgtcgcgtggggcggcactgtcctcagcgttattgataattttcaaaccagtactcgtgacgacctgctgttcacccagttcatgggtgataacttgaaaaccaacgccgcaaacggctcaacaccgttggttcaaaaagccgccgctaagttcggcgcacagtacgtcaccatcccggcaccactctacttgtttaatgatcaagcacaccaagcattggctcaagaaccagccattacaccggccatcagtaactttgaccgaatggacatgctatttgccggaattggcaccttagcatccattgactcgattcccgtctggcatgaacatcgccaagccattctgggtggcgctgatccgcaggcggtggtcggcctgttatacggtcggccatacgacatcaatggtcacattctgaacgccgaccacgacaaactctttggcgctaaaatgcccgccattctcaaagtgccgcgtcgtttcggcatcatcaaaagtaagttcaagagcgaagccttacttggcgccctccgcggacaattactcactgacatcatcattgatgaagccgtcgcgaatcgggttctccaagaagatcaagccacaccactatccaaataatccgcttcttcgaaaacaggtaccaacgctgaccgttgccggcagcttggtacctgtttttatgcttaaaatcagactaccaaataccgataactttcatccagagggcaccaacgccaccccaaacgactaggtagaagagacctaaaataaagtttaactgccaccacttaccctgagtaacatacccagaaccgaagaggacactcgctgggccgttcgcataatgcgtcgtcgaagcgaagatcgaaccagtaaagcccagcatcagtgcagcaaaggttgctggcgctcccgcagaaaccgcgaccccgagtaaggcaccgtacattgcagaaacatgggcagtcccactagcaaacaagtagtgactatagaagtagaacaggacgagtgccgctaaaacaatgccccaactgaagcctttcaaggcaccaccgattgctcccgacaaccatggaataaagccaagtttattcaactcattagccatgaagatcaaaattgagaaccataccaaggtgttccaagcaccagtttcgtgtagcacgtcatctaccgatagaaccccagcaacgagtagcaaggagacggccataaaggcaactaatgaagcttcgagaccgataaagctggataacatccataagactaaggctagcaagaagacaccgcccatgattttttctggaagactcatcttacccatctttgccagctcatcatccgcccattgcttggcattgggcgtatctttgatttctggtggatacattttataaattaaatatggcacaaccaataagcaaataagtcctgggacaatcccggctaagaaccattgcatccacgataacgtaatgtgtaaactcttggctaacgtgacagcaaccaagttaggtgccatcgccgtcatgaacatcgtactggtgattaaatcaccgtgaaattctgcgaacactaagaatgaaccgattttactttgggtgccatccttagggtcagaaccaaacgtttcagctaacgactggatgattggatagacgattccaccagcacgggccgtgttacttggcgttgcgggcgctgtcactaaatcgacgccgatcaacgcgtatgccaaacctaacgttcgtttcccaaacaatcgcacaaacaccagcgcgacgcgtcgacctaagccagtattgatgaacccacgtgacatgaagtacgccatcgcaatcatccataccgtactactcccaaatccggcaaccgccgtatccatcggcacgatgcctaataatacggtcagtgtcaatccaatgattgcaacccccgcgattggtaacggccgcgtaatacaaccaataatagttgcgacaaaaattgcaaaaatatgccaggcattcatcgaaacactggctggtttgatgggactacttagccaaataatcaaacccactagtaacggtgcaataaaatcacgatacttgactttatttagtgtcatctcaattcctcctacctaatttacgcttcttttttatgatgccacattcatcatggtcagcatcttggctgcaaagtgttgcatccgggcacgctcatcatctgataaatcggcttcaatcaccttttggagcccgttgcggttaataacggcgggtgaccccaagtacaaatcgttaatcccatattgaccagacaaagcggcggagacgatcaattcagcattttcgtcgtttaagattgcccggcaaatctgcatcaaactaacggcgacgccatagaacgtggcccccttctgactaatgatctgaccacccttgccacgaacagcttgttcgatttcagctttgaactgatcatcgaccgtggtgaccgtcttcagaggttgatcattgatcataatttcatcaaagttaacgatggaactatcgccatgttcaccaagtaccgcagcatctactgccgtagtggggacattcaacttctgagctaaggccacccgtaaccgtgctgtatccaaggaagtcccggtaccaataacccgattccgtggaaatccggagagccgttgcgtcatcgaagtcaaaatatcgacgggattacttgaaataacgaagcaaccattaaaaccactcgcaaccactggtttgacgatggattccagaatcttcgtattgcggttgattaaatctaaacgactctcaccaggcttacgaggcacaccagccgtaatgacaacgatgtcagcatcacgcgcatccgcatattcaccggtatgaatgttggtcgcattcgtaaaggcggccacatcttccaaatccttaacgtccccctctgcgtgcgttttaaccaagtcaacgataacgagttcatctagggcgcaattttggaccaatgaaaaggcaaatgatgaacccaccgagccatcaccaacaattacgactttgcgttgcttcttatccatgtcaatatccttctttcatcaaaaatgtgtgctgcacatgtggttccaactacttagttacttaactcacaagtattataacgcaaatgctttcatttttgctaattttttaaaaataaattatttttttgaaaaatttaaatataattgttgtttaaaacgcctgcgtagcagcatttaaaattattttgattgtgaactatttctaaagtgtcggcttgtgaaatcattttcgtaagcggttacaatcctgcgtttaaattgcctgattggcgtcaattcgaaacatctgcgcaagttacaaaactttttacccgccaaccgatcttgaaacagttaaaacctgattagcgtggtatattagaagtacgacttaaactagagaggactaatacattggataatgaaactttaaaagactatctcgcaaacaactcccaagttattaccatttttatggagaaagcaaccgattttctgaatcgaaaaaatgaggaccgggcgccagcacgccgctataacgatgctgaaatcgcccggcaagcggataagatgctcgatgatgtgattgccaatattcatgataaaatcgtcccccatacccgcgaacaaacaccggctgcctgggaacaatttctgagtgaaaacgacgtacttgatgatctggaactatcaatgacggaattgtcattcgaatcggaagactaaactagcagttcaaaataaagaaaggaccgtggaagatttaacttccacggtcctttttagaacaaacttatatcacatgacatcaacacaaccgaattataggcccaagtactacgaccgagtcagcccagcataaatcttatcaagattccacttcaacattgagtagtacgtatcacccggtttgcctttagctgccagcgaatcggtaaaaatcgtactagcaacggggattcctgtctcctgtgaaagcttattcatcgatttcggtgatacggatgattcgacaaacaaacttcgaacctgggttccttcaattttcttcaacgccgtccgcatctgagctggcgtgccttgcgattccgtattcacttcccaaatataagcagcgggcacatggtaggccgccgagaaatacttaaaggcgccttcggatgtcactaataatcgttgactcgtcgggatctgcttgaatttggtttgagcgctctcatgcagttttgttagttttgccacgtagcgatccgtattcttttgataaacagcggcgtgcttaggatccttggcctgcaacgtccggttgatgttcttgacatattgaatcccgttggcgagatctaaccaagcatgggggtccggctcattaacgttcgtcgttaaatatttgaccttaattcccttactggccgcaaaaacatcgtggtcaaagtcctttttggaagccgtcactaactttttaaaccagccattaccgccagtttcaaggtttaagccattataaaaaatcacgtcagcttcggcagttgccgcaatatcagtgggccgtggttcatactcatgcgggtcagtgccgcgcttcacaatgctgtaattttggacgtactgcccacccacatttttcaccatatcatctagaatcgagttcgtacttacgacccggattttggcactagtggtcgtcgctttggcactttgctggcgttgattcagaaatactgccatcccggtaaccatcgcgatgactccaatcagtgcaattaatttcgttttcatgctgtcacccgtcgcgctgctgcttgccctttccaaagcgtcggcaacaaggcctgcttaggtgagatgatgaaagaaataccgaagaaaatagccgctactagcacgatggccggaccagaagcccagttcaacgtgtagctgagatataagcccaccactgaggacaagaccccaattaaggctgacagtccaagcatgactgccagtcgttctgtccatagaaaggccgtcgcagccggtgtaatcaacatcgcgaccactaaaatgatcccgacggtttgtagcgctgaaacggtcactagcgttaagaccagcattaacgcgtaatgtaacagttggaccttgagaccataagtcttcgcaaaggtcggatcaaatgacgtaatcagtaattccttgtagaagaagaccacgaataaaatcactagtcctaacacgaccgtcgtcgtcatcatatcagtatcactcacagcgaggatgttaccgaataagatgtggtgcaagttcgtcgaactttcagctaatgaaattaggataaaaccgagtgcgtaaaacgcactgaagacaatcccaattgaggtgtcagtcttaatcttactacggctcgcaacgaatccgatcaagctagcggctagaattccaaaaaccgaagcaccaattaggacgttgataccgagcatataagctaccgcaacaccaggtaaaacagcatgcgagatggcatcgcccatcatcgacatgcctcgtaaaataataaagctaccaataattcctgacatgaccccgaccataatagccgtaattagcgcactttgtaagaaatcatacttccccaaagcagccataaaggtcgtaattgattgcatcatcgcgtttcctccttcgtaaacaggacggccgaaagatcagcactaaacgtccgttcaatgtttgcgggtgtgtagaccgcgtccacgggaccataatcaacgataccgtgatttaaaatcacgagatcatcaaagtaacgtgaaactttgttcaaatcatgatgcacgacaataatcattttgccggcatcacgccactgatgcaagatcgtcatgatagccgtctcactctgtaaatcaatgccgacgaaaggttcatcaagaataatgatatcggcttcttggactaaggctcgagccacaaagacccgttgtaattgtcctccagagagctgactaatttggcgctgtgctaaatcggctaactcaagttgctcaagtgcatcttggcaacgctgacgatccgccttgcttggttcgcggaaaagtccgagtttgccataggtcccagtcaaaacgacgtcaaaaacattgattggaaaggttaagtcgagatctttacgttgctcgacatatgcaatctgtttttgaaattgttttagcgcacgaccttcatattcgacggttcccgtttgggatttgatcagaccaagcattgctttgatcatcgttgattttcccgcaccgttgggaccaatgattccagtaattttgccggcgttaaagttaacggcaacatcagtaaagactggtgtgtcactgtatgccacggtgggttttgtacttttaacatcacatttcctccgttcatcgcggtagtcggttttctacatcgtcataagcataactgataattaacgctaatgcaaataattgttaggtatagttaacttttttataattggtattaaatttccgttcattctaatactatttctgcttaaccaaggcgttacaaccaacatactaaaagcttaatccagaacctactgaaacgactttcgatgccatcaccactaaaaagcactgaccactcatcaactaagcattgcaatcgtcatttaatttccattaatatttggtattaaaaaagtgtcgtcacctacaatcacgacactcattattaagctaatatatctgtctgcaatccaataaaaatcgtcaaaatcaacaaatcggccgagccacctaaactatagttatggtcgacaaaaatctgattcaattcgcgtaaaaacgccattccagcttcactgcggcttccccctaaatcgaagtagcggtgtgcttggtcgtggacccagtcaatgacgtgcgggtcgtgtgcccgttttaccagattggtatcgaccgtcgcctggacaatcgccatcagtgtgtctaataaccgctgattaatcgtgccacgactacgtctcaatgcgggtagtgccacttgcatcacggtcggataacccgcctcggcttcaccacgaattcccttgatgccatatgttaagtattgacgttctccagcagttaaggtcgttggatccttcgtgtttaaatcattaaaatcatttgccgttaaccccgccagcattgtgcgcacaatcgttgctaagtcgacgtcggggtgctgcaactgatacgccgccgctgtcactagcacgcccagtgagaacaccgcccctttatgggtattcacgcccttggtcgccgcaaacatggtttgttccgcttgaacaccaatgccccgaatttgcttgaacaaacccgtcaaatcgacagccgtatacgcgacgcccgccgctgcacaagcattaaagtagggggctagactcaaagcactatcaataaacataaaagcgttcatgtctggatggggacccgccgacaacgggtcgaccagcccgggcttagggttgaccgtcacttcgtataaaagcgctcgtagcgcatgattgacaattatcttcgtatccactatttctccaccatttcatccttagtctaacaacgatgatgtgcctgggtcactttcagtcctgattaagcgtgaccacaaccaacattcagttaccattacttatatttccatcataactgatactagtcaatttttgtcatttttctttgtattcttttgtcgactgctgttcaagcatcttctgaacgtgtaagctagagctaatcaaagttattcctaaggaggaccctgtcatgatacctagtcagcattttcaatccactccaaccgtccaatttgacttattaacatacatgattggtagttaccactacaactggcatccgcaaatcgaactcttatggttattgcaaggtacggtcgaagtgaatgttgacgggacgcgccatcaattacacgcaaatgacctcatcttgatcaatgccaatcgcggccatgccacctttgccttgaccccagaatgtatcgcgctccgtttacatattctgcccgatttctacactagtcagggcatcgacctcagttcaggtgcttttctactcaacatcgtgacgacgccccaacaccgtgactaccaaacgattcgccaaattctggcacaactctatctaggattacatcagcaggactggccaatttttgacttgaacgccctgtactttcaattgacgaacctgctacatcacgatttctttgatactggaatcacgatgacttatccccaacccaagacgcagagttcactaaaccgggtcattgattacattaaccaggcttacgatcgaccaattaccttaaacgaagcggcaaaaatcagtcactattcaccagcctatctctcacgcatcttcaaagcggaactcggcctgaatttttacgaatatctaacccgctgccgactacaacacgccatctacgatctggaaaacccaaccacaagggtcgccgatctagccttagccaatgggtttcaggaggtcaagtcctttaatctaatgtttaagaagcattttggtcagacaccttccagttaccgtcaacacttgtcacacgggcagcgtcctgaatatgaccagttcaagcaaccgctcactcccacacaaactaccattgtccaaaagcaactcaatcactgggcccaactcacaagtactgatcaactcagtgcttgtgaaagttgcatgtataaacgacattttcaagaatatcaggcgcttaaacaaaaaatcgcgcaattaaaaacactgctcaatcaataattaatggcataacaatttttgtgattacgaacaactgaacttaccgatattttgatcaaatattgggtcataccaaggtaagacggcatcactcgtcagaaggccttggtatttttttgtcatttttaaccggctacctgtccgcttaccatcactttcacaatccaatacctggcataactcggcgagtagcggttagttttgtatcacacagttacttacaatgtagctgtaaattgataggaggaaaccagcatggatacaatgacatacgactataccgaaccaacattatcaactaagagccaacggatgcgcgacattttggccgattatattgcgctcatcagtcatcgactaccagatgatgtgactgccaaactcgaagaactcagtaagatcgaagtcgatccactccaaaagctcgtctacgatacgatgatggaaaaccaattacttgccaataaacttaaacgcccaagttgccaagataccggtgcgttacaattcttcattaagtgcggcgcgcagttcccactattaggcgaactcaatcaaattctgaaggacgccgtttatcgtgggacaaaaaaagcgccactccgacataatgctgttcagacatttgacgaatacaataccggtatgaacattggtgacggcatcccctcgatttttctgcaagttgatggtaatggcactgacatctcaatgtacgtgtacatggccggcggtggctgcacattacccggggctgccaaagtcctgatgcctggtgaaggttacgaaggcgtcgtccgtttcgtgatggatcgcatgacgagctacggcattaacgcttgcccacctttactcgtcggtgtcggcgtcgccacatcggttgaaacggctgcgcttaattctaaattagctttaatgcggcgcgtcgatagtgaaaatccaaacgctaatgctgccaaacttgaacacttattagaagacggcatcaatcacattggcctgggaccacaggggtttggcggtcaaaagtcagtaatgggtgtcaatgtcgagaataccgcccgacacccatcaacaattggcgtcgccgttagtaccggctgctggtcacaccggcgcggacttatcaactttgacgcagatttaaactatgacttaccactgaacaaaggagtcgaattatcatgaaaacttaccacttaaccaccccaatttctgatgacgatattaaggacattcgtatcggcgacatcgtctacttgaatggctcactaacaacctgtcgggacgttgcccatcggcggctcgtcgaagaacatcgtcccctacccgttaacgtgacagaccgagcaattctccacgctggcccgatcattaaagatctcggccatgacaagtacgaaatggtcgcagtcgggccaacgactagtatgcggatggaaaaatttgaagaagaattcgtcaaacaaacccgtgtcaaactaatcgttggtaaaggcggcatgggaccgggaaccgaacgggcctgcaagaaatatcacgccttacacctcgtctaccccgctggcaatgctgtttatgccgccctgcacgtcaataagattgttgatgcccagtggaaagacctcggaatgcccgaaacactctgggcgtgtgaggtcaaagacttcggtccgttaattgtctccatcgatacgaatggcgacaacttgtttgaaaagaacaaggtcatcttcaacaaacgtaaagaagctgagattaaaaaaatcaacgaacaagttaaattcattaaataaccgaccattaacagcctaagcggatcaccctgcttaggctgttggtctaaaggagtctttctcatgattagtatggatacacaatctactttaaaaacccaagctttagccgctctgagtaccgtgatcgatcctgaacttggtgtgaacattgttgacctcggtttgatctacgatgttgcttacgatgctgacctaaagctctgcaccgttaccatgacactgaccatcatgggctgtccactgacaggctatttgaatgaccatatcaaaagcgcattaatgaccgtcgcgggtatcgatcaggtactcatcaaccttatctgggaaccggcctggtcgcttgataaaatgtcacgggcagcaaaaatgacattagggttgcattaattctaatttagaaatcgtgtccggattagcatcatttgctgactagtttcagaggggcttaaactggctacttttatgattagaattggcatattttaatgcatgcttcatgaaaattaatgcacacaatgtgaacttactcctgactaacgacttgattctataaacatcacgccctaaccaataacaatcggctttccaactattacttggaaagccgattgttaatctaccatgtaagtccatcagaacctggacgtcaaaagttctgatgcgccctcaaattttcagattccacccggctaaccgtcatgtgtcgaactgaagcatattgtaaacttacgtctaatcacgacaccgaccacaagtcacccatccaagtcgccaagtccgtgaccgctatgggatacaggtggggttgcccaaccgccgataagtagacccaggtcagcgctataccgtgcacttttttgtcgtgttgcatcactgcggccacggcttgcggcgctatcggcggtaattccgtgggcaaccctaccgccattaagcgtgccttgagcgtcgacgttaaactagtcggcgctaacccatgtgctgcaaacaaccgacaaacctgtactagaccaatcgctaccgcttccccatgcattagttgaccgtcagccaatagttcgactgcgtgaccaatcgtatgaccaaaattcaataattgccgctgaccctgttcatgctcatccgccataacgacgcgcgctttgaacgccacactagctgcaattaaatctggtgctgctggtaaaatcgctgccacactggtaatttggtgcaaggattgccaaaaatcaccgccaactaatgctgcgcacttaacgatttcgccataaccttctgcgagcatccgtggcggtaacgtcaccagaattgccggatcaatgacgactaaatctggttggtaaaaactgcccactaagtttttgccagttggtaagtcaatcgcggtcttaccgcccaccgaactatcgacttgcgctaataatgatgtcggtacttgaatcaaggcaataccgcgcatataaatcgaagcgacaaaccctgctaagtcaccgaccaccccgccaccaagagcgaggacaccgtcactgcggctaaaatgggcggcactcagctgatcgattaacgactggacttgtgaccaacttttgctcgcctcaccggctggaaccgtcatcacgcgcaccttgaatccagccgccgtcagttcatcagttaccagcttcgcatagtacgggcccacattggtatccgttaccaccgctacttgacgggcacaccataccttagttaccaatgttcctaggtgatgtaaactgttaatcatgatcttgatctgatactgtttaactcgcgtcttgacttcaatgtttgtcataggcacatcctacgcccacgtttgcatcagatcatgtaactggaaagcctgttgcgccatttttaagtacgtcgcgggttttaacgcttgcggcccatcggataaagcttgcgttggctggtcatgaatttcaacgatcatgccactggcgccagctgctacacctgccatcgccatcggggtcacgagttcccaggtaccgaccgcgtgactcggatcaacgatgactgggtaatgtgtcaacgattgcaagactggcactgcacctaagtcaaacgtgttgcgtgtgtacttattatcaaacgttcgaattccccgctccaaaagcatgatctgatgattaccaccagctgcaatgtattcagctgcattgagcacatcgtcgattgttgccgacattcctcgctttaatgcaaccggaatttgggtctgtccaacggctttaagcaacgagaaattttgcatattgcgtgcaccaatttgaaaaatatccgtgtatttcgccaccatcgccacgtgttcatcatccatcacttcggtaatcatatcaaggccatgtttatcagctgccgtccgtaagtattggagtcccgtctccccgaggccttggaagctgtaaggggacgtccgtggcttgaatgctccgccacgaacaatcgtcgcaccaccctgcttggcaaccgcggccatctggtccacgtgttcagcgctttcgactgaacacgggccagccatcatgacgaattgattaccgccaatcacactgtgtggcgtcttaataatcgtatcttctgggtgaaagagacggctgctttggaccgctgcgggaactgccgtcaagattgattcactggttgcttgcacatccgcgggaagtgcttctggacgcaatccttgaattgcaattcgattattgtgcgtgaagatctcgtgatccgcaccaaattgactcactaactttgcctgcatggccgtagcggttgctggttttaatataataatcataataatttcctcctactaatcaattctcaaaagttaaggcctaagcccgcgccgtaatcggcggagtcgcttgaatactggctaacatatcttggcggacctgttgaactggcatctgcttaccagtccaaaactcaaaagccaaggcaccttgccaaattaacatccccaagccattatatgtggcgcacccctgctgacgcgctaagcgcaaaaaagtcgtttcaagcggttggtaaatcacatcatagaccgtctgttgtgggactaattgctggataattgagattggtaatggcgttccagcagtcgtcatgccgatattggtcgcgttaatgatcaaatcgctggtacgagcaacttgctgcatccgtacttggtcttcataggcacagagccggagtggtaccgaagtcgtggtactgagttgctccaaccagtgctgaacaccggcgtagcgttcgttgttgcgtttaaagaccgttacactcgcgacaccataatctaaagccgccgcaatgattgccttacctgcgcctcccgcgcctaaaaccatgacgtgcttatcaaccaagttcagaccttgatgtaagagatcctgaaaaactccagcgccgtccgtgctgtcaccaatcagcttgccagcttcattcttaatcgtattgaccgcttgaatccgttgcgctcgcactgtcaaaccatctagtagcggtacaacggcttgtttgaatggcattgaaaggttcacccccgcgatacccatgctacgaattccagcaagcgtatcagccaatccatccggtgccacatcaaacgccaagtagcgcgcatttagcccccagtagtcaaaactcaaattatgcattcgcggtgagcgactgtgccgcgcggggtgcgcgataaatccaaagagtgccgtttgtccatcaatcatgctttaactaacttcctttctaaatgactcgcaattgttgaccaagatccacgtgcgtttgttgatacgtccgcactaggtctgctaccgtgaactggttagcggctaatacttggtcggccgctccactggcgccaaagtggtccaagcctagtaccgccccatctaacccaacgtaacgttcccagccagatgttgcgcccatttcgactgcaactcgccgccgaatttgaggtggcaagacctgagcttggtaattcgttgattggcgcgcaaagttttccatcgacggcattgaaacgacactgacatcttcacctaacgtagctagtttcgcctgggcctgaagagctaaagcaacttctgacccgcttgcaatcaagattcccattggctggcggccacgctgcggtgagagaacataaccgccacgagccacaccagtcatggccttagtcttagatccggatagcactgccaaattctgacgggtcaagacgagcacggttggatgatccgtcgcgttgatggcttgccaccaagctgcgaccgtttcattcgggtcagcgggccggatcaccgttagattcggaatcaatcgtaaactcattagctgttcaattggctgatgagtcggaccgtcctcgccgactgcaatcgagtcatgcgtgaaaacgtaagtgactggtaacttcatcatcgccgccaatcgaatagccgcacgcgtgtaatcggaaaagacaaggaaggtgccaccaaagacccgcaagccaccgtgtaaagtcatcccattcaaaatggtgcccataccaaactcccggacaccaaaggcaacgttgcgctgatccggggtcaccggagtcgaccattgatcctgctcaatggtcgttttattcgaactggctaaatcagccgcgcccccgactaatcctggtaactgagcagctagcttctgaatgacggtatgactcgtgatccgcgaagcttgggcgccttcatcaaagatcggtaaactggtggctaagtcaactggcagacgcatactgagctgttgttcgaaacggtgttgtacggcttgtggtaaagcctctcgttgtgactgccaccggcaatgtgcacgctgaccacgttgcaagattagttgctgtgcgcgtttagcaacggccggcattaccgtaaatggcgcggcttgccaccctaattgttgccgcaaactagttaaaccggccgttcccaacggattgccatgcaccgcattcgtacccgcttgtggtgcgccaaatccaatcgtcgttttaacagcgatcaggcttggacgtgaactgtgtttggcacgctcaatggcggcattaatcgccgttaaatcattgccatcacctaccatttgtgtatcccaaccataactagcgaagcgctggttcacatcggtacgaaacgaccggctggtggggccatcaagcgaaacagcgttatcgtcgtacaatacaattaatttttgcaattgttgattaccggcaaagctggcggcttcgtgggagacgccttccatcaaatcaccatcaccgactaacgcataagtatagtgatccaccaactgcggtgactcggagaactgagccgctagttgccgttcagccagggccatgcccaccgccatccctaacccctgtcccagtggaccggtcgtggcttccacaccatccacgattcccagttcagggtggcctggcgtgtgactgccgaattgacgaaaacgttgtaactcgcccattgtcacgttgaagccactcacatgtagcagactgtacaacaacgccgacccgtgtccggctgataagacaaagcgatcgcgattagcccattgagactgctgtggatcgacccgtaattgtcggctccacagtacccacatcattggagccgcgccgagtggcaatcctggatgaccagaaccggcccgttcaatcatttccgcactcagtactcgtagattattcaccgctaattcatcaatttcatcaaatgcttgcattaacttcgctccctctcattttggctaataaaaaagactcacagttacaccaactgtgagtccactaattcttcgcagggtgcccgaaaaacaccgctactcagaagcagaaaagtcacacagtggttgttcacaacactgatatgacttttccataaattttaatcattccaaaatttactggtcacatccgttgcgagggcgtgcctcgcagtggatgccaaggcactaagtaaaccagtaataataatacgaattcaattgtaaattggtattaatcgtcatgattaaaatctccttaatttataatgtgtatttgatgacttaaaatatacggctaatcaatagaattgtcaaatggtttttgcaaactttttctattaatcaacaaaaacatgttggtccaccctcgatttgctagtcgtcatcatcctcgctaactgctaataaatactggtaaatcagcaagtttgcgtgtcaaatcattttacagatattaaaatggttccctgccactttctgaaaatatttttagccagtagcttgcactgacttaacttataatccaccgcaagacaaatcattaaagtctaaaagccgcactccaacgctaaatttctcacaacgaacgactgacaaacggtcattttcgattacaatttcaacaatgttccgtatgctttagcaactaaccttagccgctcgtcagttgtctgaactgccatctatgcccaaccagctagctggtcttcaccaccgcacataatcgtgataaccaaaaatagtatcgccagcatccagagcagattccagccacactatcatcagtttatgtgatccccattttagtcacaataattgccgcaactacaccaaactacgctttcaaggctgcggggactgccactccaaattcagcaccaacttgctgcatttccgtcaacgtctgtggatcaatactgacgccctgcaccaaattttcatcatagtgccggtattcccggtcacctggtatcatgatcttagtacctggtagatgcttcaaatgccgaatacggtcaaacatagtcgtcacgttggccttcaacacctcgggatcgccaaataaggcgggattaatcgtcatgaagaactgactaaagtcatgcttaccggtgttcgtatcagccgacagcgacccttgcgctaaaattcccgtgagtaactcaataattagtgagttgccaaagcctttgtaatttgaattgacttcctgctggccacctagggtcaggaccccaccaccaggacgattctcagaaaacgcaattttagtcaagttatcctccaccgtctgcgcatcatgcaagacttgacgatgctcatcaaccgcccaatcacccggaatctgtgcaccttttttggccagcacttgaatcttcccgcttgaaaccaccgcagtcgcgccgtcaaaaacgaaaggatgcgggtcggctggaaaagtaaaagctaatgcgttggaacccaaaaaagcttctgtcgcattcgtcggcaccaccaacggccgcgtattagtcgttgaaataccgatcaaacccgctttgcaagccatgcgcgaataatagcccgccgttccaaagtgattcgaattgcggataaccgctaatgaaacaccgagttgcttagtcttttcaatcagtttattcatcgtaaacgccgacgcaatctggcccatgctctggttcgcatcgatcaatagactggtaggtgtttcattcaaaatcttcggttgatgcgtcggttccaaggtatgatccttgatcatccgcgtataccaagccagccgctggataccatgtgacgagattccacgtaaatctgcatcgaccagggtgtctgccagcagtgccccatccttggcactaaaccgttgggccttaaaaactgcttctaaaaattgtcgttccgtttccgcactaattcgcatcgttatattttcctccgtttttgacagccagcactcgcctaacttggcgagcaccgggatatcacactttattcagattgttaaacagcttgaacacgttcattatccgattcctaattagaaaattcaatgttttatgtaaatataattaaaaacagatgtgtaaaacgttaatttttcaattatgccccactcagtttctttccttaactaacctttcactatccgctaagcggcctgtctttccatgctatattgaagacacttaaactagaggagggacccgcgatgcaccgttatacctatcatttttatacaggactaatcacgggcttgttaatttgggtccatcccctcggcggtctagctagtcgcgtacgaccgacactaccgtacccaccaaccacccttcaaagaacagccacccaagctgttttttcaccaaccgaattttatcaaaccatccgtcagtatccggatctggttaaactagcaaaattcgacccaatcggtatgttgcaaggcaccaccattcagccgggactacaagccaccctgactagggacctcgtcactaaacaactcacgacgacgacaatgatgattccacagggcgttgttattgccggtcgttatcgtctaaccaccgcttatgatgccactggtcgaacccaatctgtcctatatgtacaggatcgtttccgacatcaattatgcaacactgtcttattgcatggtaaaccacatgtgggtggtctagcttatgatcctcaccaccagcggatttggttgtgcagtcatcgccacggtcatggggctatcttgagcgttagtctggccgcattacggcacttcgacccgaccacttccattgccgttcactatcagcaacgctggtcactgccaacactgagcaatgcttcactactgacctatcaccatcaggccctttatgtcggccagttcaaacctggacagaccaccttggttgcccgctatccactgacgagcgccggcacgccatacagaatgaccacgagtcacgccattttaccaaaggcagttagtgactggcacggcaagctcccacccaatattcaaggaatggccttctatgaccactacgtcttgttatcacagtcatacggtcccagcgcctcacacttactgctattcaagcgcagccaattaattcaacagcaccaactgaccaccggtatcgcgattcttcgattgcctccgcaactcgaacagatcagcgttcatcatcaccaggcgcaactcctttatgaaaccggggccaccccctaccgccagcagcaaaatcacgccattgatcggctgatttcaatcaacttacagcgcctcattgaataggcaaattagtcgtcgaacctcatcaccatgactgaaaagcacggtcctagtcactacgccattattgcagttaacccataactgaccttccgatgcgtccagtatttactgacatgcccagttcaatttcttgatcagcattcacgctgctaccaggattgcgacaaccaactagttgttaccgtaaattactgctgtatgtaaaaatacagcatgtattaattttccatggccgcccaaataagcgtacaatgtaacagtaagtacaattaagggagaaagctatgtatcagctattaacagattcaaccgttgatttaccttatcaactacttaaggacaagcatgtcgattttgtttcaatgaacgtcacgattgacgaccaggaatacgcggacgatttgggtcaccactttgacttgactgacttttatcatcggattggtaacggtgtgatgccttctaccgctcagattaatatcggccagtttattgaatttttcaagccgtacgttcaggcacatacgccaatcctatacctcggcttttcatcaggcttaagtgggaccttcaataatgcgcaacaggccaagaccatgcttttgcaagaccagccagatgccgagatctacctcgtggattcccgagcagcctgctgcggtgaaggcctgatgctactagatgccattgacaagcgcgatgctggtatgccgatcgcccaattggcggattggctgactgaaaaccgcctctattatcaccaatggttcaccgttgatgacttaaattacctttatcacggcggccgggtctcacggacctccgcgacggttggatcactcttacagatcaagccagtcatggacgtcgacccactcggccacttgcgtccagtacaaaaggtgcgctcacggcgccggtcactgaccacactagttaacaacacactagccgatttacgtgatcagaccaagccgcgcattatcattgccactagcgacgctcaggaagccgcccaaaccgttcgtgaaaagattttagccaaggttcctgatgctgaaattttgctcgaacacattgggccgaccatcactagccataccggcctcggttgcgttgccgtcttctcttttggtaaaactaaacgtcagtaattaaaatggattgagccgtcaatggcccaatccatttttaagtaaccgagcgttacttgcttagcttgtttcaaggcgggctaactgcatagtcgctcaccccggaagtcgtactgacatgaacacgtgctgccagccaggacgctaacaaagtggtctattttatatcatgagccctaccatgttttagttttgtgttattttttctgttcaaacaacaaaaaaagcacccgtccatagacaggtgctttctcatatagccagaaaatgttgataaaacaacgtttttggataatattaacgttttgagaattgtgaagctttccgggctttcttcaaacctggcttcttacgttccttcatacgagcatcacgagttaagagacccgcgcgcttcaaaggagtacggaaatctgggtcaacttcgagcaatgcccgagcgatcccatgacgagttgcgccggcttgaccatggaagccaccaccattaacgttaactaaaacatcatattgatcagttgtttcagttacttcgaatggttgtaacaattccttgcgaatatctgcaaatggaatgtaatcttcaacagatttgtcattcataacaattttaccagtacctggtactaagcgtacgcgggctactgaatctttacgacggcctgtgccgcgatattgtacttgagccaatgtagtttcctccttagattaagttagtgatgtccaaaacttcaggcttttgtgcttgttgcgtatgttctgcaccagcataaacatgcaacttcaagcccatcttgtggcctaaagagttgtgaggaagcatacccttaactgaagtttcaatcaatttagtaggttcctttgccaagaagtcaccggcagtccgttcctttaaaccaccagcataagcagtatgatgataataaatcttccgttctgctttcttcccagttaaagcgaccttgcttgcattaataacgataacgttatcaccagtatccacgttaggggtaaaggtaggtttgttcttaccacgcaagattgatgcgacgacagttgaaagacgacccaaaggtacatcggttgcatcaactacataccatttacgatcaatttcacctggtttagccatatatgttgtacgcacgttgtgttcctccattttctgtgtttgtttgacactcaataagatttccggggcttatcgtggggcaaacaataccaacgactagtctacccaatttcgcctcagaagtcaatactttatcaaatcagcttgtaattcattttgttcataatacacttttttcatataaagtccagccgcaggagccgttccccgcgcttgctcacggtctttagccgctagtaatgctggaatacagtcaactgcgcgccggccctgaccaatttccatcaaaacagccaccatgattcgaacctggttatataaaaaaccactaccgcaaaattcaaactgaatttcgcgttcatccggcaaggcccacgctttggctgaatagatctcacgaacatggtcatgtgcttgcgaaccggacgcaacgaaggtcgagaaatcgtgccgtccttctaagtcaccgatggcttgctgaattctgtcaatatccgcagcgaacttaaaatgccccgtatagtgccgtttaaatggatctacaaattcattttgataggcccgataccagtaccgcttaccgaccgtatcataacgcgcgtgaaaatcattcggcacaatggaaacggcctttacgattgtatccatcggtaacatgctgttcaggccgcgccgaaccccttctggattaatttcgtacggcaagtcaaaatgcaacgtctgtccaaacgcatgtacaccagcatctgttcggcccgcgccgtagatcacaatcggttcaacgggatctttcgccatcttattgaccgccttagtgacgacctgctcgacagttcgctggtgtggctggcgttgaaaacccgcaaaattggtgccgtcatatgctaaaactactttataccgcgtggtcacaatatccctccagttaaaaacgtgggtcgccatcagtgcgacgcccacgttaatcagtcttcatttatgcacgcaagaaaatcaatgcaacggtcaagatcgcaaagcatccggtagcccacgtatcacgttggtgccacttaagaatccggtacttactgcgaccctcgccgccttgatagccacgtgcttccattgccgttgctaaatcctcagcccggttgaatgagctgacaaacagtggaatcagcagcggaaccacggcacgcatttgttgaaagatattgccctcaccaaagtcgaccccccgggcccgttgtgcattcataattttttccgtttcgtccatcaacgttggcacaaagcgtaaggcaatcgacaacatcagcgccacttcatagactggaaaacgaaccgcccggagcggcatcaaaatatactcgatggcatccgacaattccagtggcggcgttgttagagttaacagcgttgacataaaaataatcaacacgaaccggcaaaaaatatagaccccgttgatcaatccaagttggctgattgtaatgatgccccattgaaagtaaacgtgcccgccacttgcactaaacaacacttgcaggatgacggtgaataaaatcaaccaaatcagcggtttgacgccgttgatgaagaacgaccatttcacaccggataggtaaatagcggccaatgtaaaggcaaatagcaaggcataggtcgcccagttattggcaataaaaataatcccaataaaataaaaactcagtaacagtttcgcccgggggtccatatggtgaaccacggagtctcccggaatgtagcgaccaaagatcaatttattcatcatgagcggccacctcccccatcgcgttcggtggcaactgttggacgatggctgctgctaattcgtcctcggtcaacggccactcattaaattgccagccttgcttttggagtgtatgtgcaaaggccgttgttttcggtaagcccagttgatgggcagtcagccacgcaggatctttgaagatctcacgaggcgtccccgttttgacgatttgtccacgatccatcacgattacattatccgcgtaattggcaacatcatccatctgatgggtcactagtaccacggtcaaatcacgttcatggcgcaaacgggcaaacatttccatcatatctaaacggccctgagggtccaatccggcagtcggttcatccaagactaggacttgcggctgcatcgcaaggacccccgcaatggccactcgccgcatctgtccaccagagaggtcaaacggtgaccgcgtcagtaacgactcgtctaacccaactaaagccaacatttcagccgcagttttcaaagcatccgcttcgctggccccaaaattctggggcccgaatgcaatgtctttggccaccgtttcttcaaacaactgactttctggaaactgaaagacgatgcccacgtgttgccgcaatcgtttcaaatccttattactcgtcgttggcgtaatgacccgttcaccaatcgtgaccgttccactagtcggtttgagtaaggcgttcaaatgctgtaaaagtgtagacttaccactccccgtatgaccaatcaaagccgtataagagccggtgggaatggtgacgttaatatcagttaacgccttagtttcgaacggcgtacccggttggtaagtaaaatctacttgtttgaacgtaattgccataaccagtccgccattcctttctctgttaaatactgtgcgggcacttgaacaccctgccgctttagcgctgcttttaagcgctcagcatatggcatgtccaatcccatcttaattaaggcttctccatgctgaaaaatttccgctggagtcccctcttccttaacctcaccgtcattgatcactaagacccgattagcgctggccgcttcgtcaatatcatgcgtaattgacaagaccgttaacgctgaattagccttcatatcgcgaatcgtcgtcaatacttcctgacgaccacggggatccaacatcgacgtcgcttcgtccagaatcaaaatctgaggccgcgccgctatcataccagccagcgccacccgttgtttttgaccacctgacaaacgtgccggttcacgtgtcgcaaaatcctgcatgttgacttgttctagggccgcttgtacccgcgttagcatctcggaacgcggcacgccctggttttcaaggctaaacgcaacatcatcagcaacggttgccccaacgaattggttatctgggttttggaaaaccatcccaattttgcgccgaatgtcccaaacggtttcttcagataatacttgaccatcaaccgtaatcgttccggccgctggtgctaacagtccatttaaattcttggccaaggtcgacttaccagaaccgttatggccgacaatggcgacccattcacccggcataaccgtaaatgaaatatcgtgtaacgttaactgatccgtagcttgttgcgggtaacgataatctaaatgtttaacgtcaataatcggactcaccattgtccctcatttccttaaaattcatggttattatcataacatatctgacggaacttgtagtaactgaacttcacgtccaatcttactttaaatcagtggctggcccgtatttgtaaccagcatcgccaaacagcgtgaactgcttcttcaagttattggagacgtatacttttttatccttggtaataaaaatggccccaataccttgatccgctttaccattaatgtacttcatcccgcctttgaggcctttgtcaaaggtggccgtcgatagtgcatcgccatccaccgacttcttcgagatgatggaaacgcccatcaaattgttttgataaggggcccctgtttgtgggtccatcaaatgactgtaaactttaccattcttcttcaaatagcgttcatagatcccagaagtaacgattgacttattcttagcaggtagtgagccaatggccgtaccccgtgacgcttttggatcttggataccgactgtccagttacctgacttcgttcctttagggctgtcacccagaacataaatattaccaccgaggtcaataatggccgttgaaaccccatgatttaataagtacgtcttcacttgatcggtcatgtaacccttggcaatcccaccaaggtctagttgcattcccttttcttctagataaacggtccgtttcttgtcatttaatttaacttttttgtagtctaccagcttaacgttcttgtcaatttcttgttgagtgggcaccttggcatcagaaaatccaatatgccagagtgatgtgatcgggccaatggctaaatcaaaggattcgtctgaattcttactataatagtaagctgctttgatcattgggtagatatccttgctgacagccactggctttttaccggcagcggcgttgatcttatcaatttcagatcctttttgattgaccgtaatttccttagcttccgttttcaacagcttaaacgccccagctaacacgttatccttacccttattataaatccgcaacgtgacaactgtgcccatcatgaactgggtatcctcgatcggcgtcttgacgaccttagttggtttgggtcggctactagcagcatttttgcgactcgtactcgtcccacacgccgtcaatggcacgatcattgcaacaattaatccaattcgaacccatttttttagcttcattccaatacttcccctatttttaatttcaattgtcattataccaaagtcttgattcatccggtgagactgtttgcgcgtcatccaagcttttctacgctagtctgacatcagcgcacctacagcaaacggtacaactcgacggtcgggtttgtactaccacagccattttgcacttaacattcaccgccactattattttttaaaccaatatccatgtatggatttagcttgctcaaagtcgtgcccaactgagtgacaaacttttgtggttgttcaattaaaaacaaaaggccctcagcatgcgcctcaggcctcaaaagaatctaataattaaattgcttattcagagaaaatcatgttgtcaacagtaatcgtgttggtgtcacccttttgtgccgcgttttgtaattgttccgcgtacataataaaggtgttagaagattcagtggcacccgtgacaacgtcaaccttagttggatcactactcttaactaatgacttgttcaaagctggttgataagtcttagggttagtcttagcaaccttcttcatttgcttgttgtaagctgcatcgtcaactttggacttgccattcttgttcacttggttatattcagacttcgtaatcttattatccttgaccgtgattgcgaaagtaactttgtaaccgtgtgagtagttcttttcgttcaacttgtaggtaccatctttcatcttggcaccattgtcaatcttaatggtcgacttgttacccgcttgggcagcttgaactaattgttgtgtgtagttttggaaggtctttgatgattcagtcgcaccagtcacaacatcaatggagcccacgttaccagtagcggcagagcccgtcagcgtcttgtttaacttaggcatgtaagtcttggggttagtcccagcgatcttcttcatttgtttgttatatgaagtatcatcaactttggacttgccgttcttgttcacttggtcataactggacttagtgattttaccgttgttattaactgtgatactcatcttggtccgataaccatgtgaataattttcttcttcaaggttataagtacccgctttcattttgctgccagcggttaatttagcaaccttagttgtcttagctgatgagcttgaagatgaactcttcttggatgaactcgagctataacttgaagaactgctgccacaacctgctaaagctaaagctgaaattgcaacaactgaagcacccgtaataactgatttgaatttcatgatatcccactcctaacctttttgtatgaaaattcacattaatcttaacgtttaaactggtaatagtcaatcccattccattaaaaaaatgatattttagcctaataatagcggtattgacaacgttttccgttcaaacctcgatgccactattttcgcggcttagataatgtgatagtttatgcattctttcccataatccatagacaaccgcttacattatcgttataattattagtggaattatctttttacactattattcaagggagttgttacgcaatggcaaagaaaaatattgtcgttgtcggtgcggggtttgctggtgtttacgcaaccaagaaactgtctaagcatttcaaaaaaaatgcagacgtcgagattacgttgattgaccggcattcatacttcacgtatatgactgaattacatgaagttgctaccgaacgggtggaacctgagcatatccaatatgatttgcaacggttgttcgcacggcgaaaaaacgttcgtctcgtgaccgataccgtgacgggcatcgacaaaaaggcacaaacagttactaccgaacacggaagttatcaatatgatcaacttttaattagtttgggtggggaatccaatgactttgggactcccggtgttaaggaacacggcttcgaattgtggtccttcgaacaagcgatggcattgcgcgctcacttatctgcaattattcggcggggggcggcggagctcgaccctgctaagcgcaaagccatgttgacctttacagtctgtggttctggttttactggttctgaactgattggtgaattaatcgaatatcgtgatgttttggctcgagacaacaagctcgatccaagtgaaatcacgctccaattggtcgaagcagcgccgactattattaacatgctcaaccggacgcaagccggtaaggccgctaagtacatggaaaaacatggtgtcaaaatcatgacgaactccatgattaccgaagtctgtgaagaccatgttaacttaaaaggcaaggatccaattccaacctacacgttaatctggacagccggtgttcgtgctaatagtatcgttaaaaagttcggcattgaaactaacccccgcggtggtcgcttgatggccaatgaattcatgcaagctaaggattgtaacaatatcttcttagccggtgattcaaccagctaccaagaacctgaccaaccacggccagtcccacaaatcgttcaaggggctgaagaaaccgcagctaaggccgtcgaaggtattattaagaacgttgaccagactgacgttacaatcaagccatttaagggcgcttatcaagcatccgtcgactcaattggttccaaatatgccgttgcacaagttttagagaagtggaacgtctctggttttattgccgtgcttttaaaacacgccatcaactggatgtactacgttcagattttctcaggttactacctattccagtacttcatgcacgaattcttccggactcgtaataaccgtaacgtcttccgcggttgggtctcacgggctggtaacgtactctggagtgtgccactgcggttcttctatggtgccatgtggttatgggactgctggactaaagttcagggatctgaatcctggttcactgacaagttacggttaccattcgaatggattaccgtggccgcaaccagtggtgcctctcaagcaactaaagccgctgcaaccagtggtgcttctgaagctgccacgtcaaccgttaaagccgctaagggtgtcttcagtctttcatacatgtacggtaaagaacccctgatggtctttgacaaaatgccacattggttcgaatcaattaccaaggtcttcattccgaacatgcaaatggccctcttcttccagaaattcatgacttgtgttgaaatcgtcattgcattatgtattttcttcggactctttacttggtttgctaacgcagtcaccattggcttagttgtcgtcttctgcttatctggcatgttctactgggtcaacatttggatgatctttgttgccctcgccttaatgaacggttccggacggacatttgggttagactactgggtcgttccgtggatgcaaaaacaccttggacactggtggtacggcaacgttcgttctcattacgacggtgttaaaacccgctagatgcgttataattaattaaatcctttcccgatggttcaagggttgtttttccccccttgaaccattttttatttcattgaattggagggttaacgatgcgtaaattacggacaatgatccggacattcaaacgttatggggatatgatcaagccgtttgatattattattattgttgcgctaattattttatcgttcaccccactagcgattttttcataccagcaaaaacaacaagctgaacatgcggcactagtggctaagcgaaaggccacgagcagtgaaaccacgtataacgccgtggtctcacataatgggaccgtcttgaagcgtgtcaatattacgaatctgaaaacgactaagcacttcacctatcgcgataaccatgggcactacaacacgatcacatttaaacctaagcgcgttgcgattacgaaagccaactgttctgaccaagtatgtgtccgccgaggctggattcataaaccgggtcaaacgattgtttgtttgccccacaaactcttggttgaaattaaggccagcaacggtcaagtcaaatctggcggtaatggtttagttacggagtagaatatgaataattcatttgaacgatcaaacaaaactcatcgtaatatttatatcgcgttactggttgcacaaggcgtgatcatcggcatccttgaacggatgattccattcccgtttgcctttgccccaggtgccaagcttggtttagccaatctgattaccattgttgcaatctatacattatcattaactgacgtgataaccctaacctggctccgtttgattttaacggccctcctaggtggcactttatcaacctttctgtatagttttgggggcgcctttctcagcctgtttgccatgctgctggtcaaacaattagggcctaaacgcgttagtattattgggatttcagcaactggtggcgtcatgcataatgttggtcagctattggtcgcgagtcttattgcacagacgtggacggtcatgctctacttgccagtgctttcgattattggactagcagcgggaagtgctctcggaatcgccgccaactacttgttcacccacgtcacgatcttacgctatctcaaattcaatcgagaacaccatccagatcaaacaaaggagtaacccatatgcaatcggcaacacaattacacccaatttggcgtgattacccggcactacaaccggagctgcaacaagtgatgcagctgatgacggcgaacatcaatattcaagatgccgacatcaatgacgcgattttagaaatgattcatggtggtggtaagctcttacgcccggcatactgcctcctattctcacaatttacaacaactgatcggcaacggatggtagccttagcggcgtcattagaaacgctccataccgctacgctgatccatgatgacattgttgacgatgctgcactacgtcggcaccatgtcacgattcaagaacgttttggtaaagatactgctgtgtatgcgggcgactacctattcgttgtggtattcaagattctagcgcactattcaagcagtttcaaaagcatccagatgaactctgagaacatggaaaagattctagtgggcgaggtccaacaaaaggaccgccactaccaccttgacattaccatggcagaatacttgcaacaaattcagggtaagaccgccgaactattcgcactgagctgttttctaggtgcttatgaatctggccaaagtagccgcttcgcacaacaggctcgcaaagccggactggcaattgggatggccttccaaattcttgacgatattttagactatcaggaagtcagtcaggaaacaggcaaacccatcctcgaagacgttgctgaaggtgtctacacctcgccgttgatttttgccttacagacagaagctaagcacgatttattgccgctgatgcgattacagggggcaatttcggacactcagcgccaggaagtacaacgacttgtcatcaatgccggcggtgtggtgcaagcccaagaactcgctaccaagtacactcaagacgcgctggcaatcatgcgtaaacttccagaccagcctgcgaagacggatctgattagtctaaccaaacggctgttggaccggcataattagctagtaatcaatcgactaaggtatcaaacatcctgtttgataccttttttgtcccccagacacagctaaacgcctatgtgcttcatcttcacagtcagtacctgagaccactatgtccactttccagattcaacaggtcataatctgcaaataacaaaccgttgtcatcacgagtattaaaaacacctatccattccaacaaaaaaccgctgatttagggaatcaatccctaaatcagcggtcgctcgtaactagcaccaaaaaaaatcacttagaactgcgatatgccatctatgtctaaccataaataacttccgaactagacttagctactattttgctagtagccaccatcataacgcccgtcaatcatcagtcccagtgatccgtaaaacaatcttaactagtcaacgagttccaagacaaccatttgtgcaccgtcgccacgacgaggcatagtcttgtaaattcgtgtgtaaccaccattgcggtcagcatattgaggacctaagtcactaaatagcttttgcaatgcagtttgtacagccacgttgtcgccatcttctttaacatcggcaacgacgtcacgcatgaatgtggcagccttccgacgggcgcttaaatcacccttcttggccaaagagatcattttgtcagcagttgaacgaacttccttagcacgggcttcggtcgtttcgatcttgccgttaacgatcaatgacgttgtcaaatcgcgtaataaggcacgacgttgtgaacttgtacgttgtaatttacggtaactcatgaacggatatcctcccttgtattagtcttctttgcgtaatgataacccaaggtcagctaatttagccttaacttcctcgagtgacttgcgtccaaggttgcgaaccttcatcatatcagcttcagttttgttagttaattcttggaccgtgttgataccagcacgcttcaagcaattgtatgaacggacggagagatctaactcttcaatcgtcatttctaacatcttttccttatgcgtttcttccttctcgaccatcacatcagtgtttttagcttcatcagtgagatttacgaagattgaaaggtgatcagtcaggattttggctgatagactaatggcttcacttggagtgattgaaccatttgtccaaacgtctaaggttaacttatcgaaatcatcacgttgaccaacccgcgtgttttcaacttggtagttgacacgttcgattggagaatacaatgaatcaacagctaaaacgccaattggcatgtcatcttcacgatgtttgttatcctcagcggaaacataaccacgaccagtatttgcggtcatacgcatatggaagtgtgccccgtctgctacggtacaaattggtaagtctggattcaagacttctacgtccgcatcgccaatgatatcaccggcagtaacgttagcaggacccttaacgtcgatttccaacgtcttggtttcgtctgattccaacttaagtgcaatcttcttaacgttcaagatgattgccgtaacgtcttccgttacgccctcgatcgttgaaaattcatgaagaacaccatcaatttgaatactagtaacagcagcgccaggtaaagaagaaagaagaatccgacgaagtgaattccctaaagttgtaccataaccgcgttcaagcggttctacaacaaacttaccatagttgtcgttttcatcaattttatgaatgttaggtttttcaaattcaatcattcttatcttttacccctttcaaaacgcgtggtgtttagtagttgtgcgtacaaaatgaagtttgccctcaaaatgaacgtcacagattaaacacgacgacgctttggaggacgagaaccattgtgaggcactggtgttacatcgcgaattgcgctaacttccagaccagtagcttgtaaagcacggatagcggcttcacgacctgaaccagggcccttaacagcgacttcaacagtcttcatgccatgttccattgatgccttagcagcagcttctgcagccatttgagcagcaaaaggtgttgacttacgactacctttgaaacctaatgaaccagctgatgaccatgcaatggcgttcccttgcatatcagtgatcataacaagtgtgttgttgaacgttgaatggatgtgagccacaccagattcaatgttcttctttacccgacgacgacgggttgtctttctagttgccataaaattcgaaaacctcctttattattattttttacgtccagcgatgctgacctttttacccttacgagtacgagcattgttcttcgtgtgttgaccacgaactggtaaaccacgacgatgacgcatgccacggtatgaaccgatttcttgcaataacttgatgtttaagctgacttcacgacgtaagtcaccttcagttttgtaaccatcgacaacggcacggattttgtcttcctggtcaggagttaaatcacgtacacgaacgtcttctgaaacaccggcttcagcaaggatcttctgtgcagaagtgttaccgataccgtagatataagtcaaaccaatgacaatacgcttgtcacgtggtaagtcaatcccttcaatacgagccattaatatttcacctccaacttagttaaattatttaccttggcgttgcttatgctttggattagcagagcagataatcatcacgcggcctttacgacgaataactttgcagtgttcgcacattggctttacagatggtcttactttcatgagttttttacctcctataaggtacgtagaccgaacctacttgaaacggtaggtaatccggcccttagttaaatcataaggtgacatttcaactgtaaccttgtcaccaggcagaattcgaatgtaatgcatccggatcttacctgatacgtgtgccaagatttcagcgccgttttcaagttcaaccttaaacattgcgttcggcaacgtttctttaatggttccttgaatttcgatgacgtcttcctttgccaagtactgtccctccttattatcagattccgtgctaccacgtatttggtccattactgaaccagtcattgtctaatcataacattaaaaaaacattaaatcagtcaacggctaaacctgaataattttatcacaacgacctttgaaaagcaaacgtcgctgctgaaggaacctggtttacaggttatcaagaattttcttgatatctttgtagacatcatcaatgtcgcgatcaccgtcgacattgtaaagtaacttttcttgaccgtaataatcaattaatggcgtgttcaacttaacgttcacgtctaaccgattcttaacggttgctggcttgtcatcatcacgttgatagaaatcatgaccgccacacacatcacaggttccttctaccttaggcttgttgtacaacttatggtaagttgcaccgcaagtccggcagataaaccgaccggaaagtcgttcaacaagtactgcgggttcaacatgaatgttgatgaccccatcaagtggcttattgagttcttcaccgatttgtttcaaagcatgagcttgatcgatgttacgtgggtaaccatctaataggaaaccatttttagtatccgcttcagctaaccgatcacggacgatgccgttagtgacttcgtctggtactaagttacctgcatcaatatacttcttggcttccaagcccatcttcgtttcgttcttaatggctgcacggaagatatctccggtcgagatatgtggaatatcaaaatcttcaagaatcttctgtgcttgagtacccttaccggcacccggtaatcccattaaaatcaggttcattgttgacatgttttttcctcctgaatgcacaaatgtgttgagtctccccaacacattcgctgattaacgaatgaaaccgacatagtcacgtttcatcatcaatcctttaatttgacgaattgtttcaagggcaaccccaacaacgattagtaaactcgtcccacctaaaccgattgattcatcgagaccccaaatatcagaagctaataatggaatcaaggaaatcaacccaaggtagagggcaccgaccgtacttagtcgcattaacaattttgaaacccaatcttgagtatccttacctggccaaacaccaggaatatagctgccttgcttttgtaagttcttagagagcttttcaggattgacctgaacaaacgcatagaagaacgtgaagagcacgatcagaatggtgtaaagaatagcaccagtcgtcgactgcatattgaagatattactcaaaacggtataccaggtttcgtcaccatgactggattggaaccctagcaaaatcgtttggggcgttgcaatgaaggaactcgcgaaaataacaggaataaccccggcaacgttcacctttaatggtaggtaactactgtcaggtgcaccagctgcacgacgagtgtattgaattggaattcggtcattagcttgttcgacccacgttacaaacataacgatgatcagcacaagcaaggctaacccaacaacaaacaagccactcttccaccagtcgctctgtgaaacattaacgaactgttcttgataaatttgataaatcgatgttggcatacgggcaatgatcccggcgaagataataatggaaaccccattaccgattcctcgatccgtaatcatatcacccatccaagtcgtcaacattgccccaccagtgaggatcaccccaatggtcaggtaagtcgaaatacttggattgttaacgagcttgagttgactcaaagagttaaaaccagccgtaatcccaatcgactgaacaaaggccaagacgatcgttaaccaacgggtcgcttgattaagcttgcgtcgaccaacttcaccttgtttgccccattcaacaaacttaggaacaatgtccatttgtaacaattgaacgatgatttgtgcagtaatgtaaggggatacccccatagcaaggatggaataatttgttaaaccgccaccactgaatgtattcaacatacttatcagccctgaagatgccaccgactgaagtgcctgtgcattaactccaggaactgtgatataagagccaagacgaaatacaatcaaaacgcccaacgtgaacagaagtttattccgaatatccttaactttgagagcgttcttcatggtagtcagcaaattagatcacctcagttttaccgccagcagcttcaatggctgcaaccgccgttgcagagaacttgcttgccttaactgttaactttttgttgagtttaccattaccaagaactttaacagcagaactcttcttaactaagccagcttcctttaatgattctggtgtaacttcggcaccatcatcaaaacggtttaagccgtcaaggttaacaaccgcatattctttacggttaatgttagtaaatccacgtttaggaatccgacggtacaatggcatttggccaccttcgaaaccgacacgaactttaccacgcgccttttgacctttttggccacgaccagaagtcttaccttggccacttgagtcaccacgaccaattcgacgacgtgaaaaacgtgaaccttcactaggtgttaattcatgtaacttcatttagtaggcacctcctctttgaaaatttgaattacttgatgatttcgacatcgactaagtgtgcgatgtggaaaatttgaccgcgagttgctgcgtcatcaggtttaacaacggaactattaatccgacccaaacctaattccttaacgattttacgttgcttaggaagacggtgagcagcactgcgtactaaagtgatctttaattgagccatgttgtttgtcctccctattcagctaaatgttcggctgaaacgccacgtaaagcagcgacttgttcagcagtctttaagctctttaagccttcgaacgttgcacgaacaacgttaacgggggtgtttgagcctaatcgtttactagtaacatcatccacaccggctaattccatgacggcacgaacggcgccaccagcggcaacaccagaaccttcaacggctggcttaagcatgatgcggccaccaccgtaaacaccaagtgcttcatgaggaatggtggtaccaaccattggtacagtgatcaagttctttttagcagcttcggaagctttccgaattgcttctggaacttcttgagccttaccagtaccgaaaccaacgtgtcccttgtggtccccaacgattactaatgcagcaaaacgtaggcgacgaccacctttaacaactttggtaatccggttaatggcaacaacattatcgtcaagatctaattttgatggatcaatgaaagtcatatggtattattcctcctttgttagaatttaagtccgttttcacgagcggcttcagccaaagcttgaacccgaccatgatataagtaaccgccacgatcgaaaacgacgtcaacgattttcttttcagcagcgcgcttagcaacaacttcaccgacagatgcagccttttcagtcttgttgttacctttaacttcgctatctaaagttgaggcacttgcgagcgttacaccctctacatcatcaataacttgagcgtagatgtttttgtttgaacgataaacatttaagcgtgggcgctcagcagtcccagaaatcttaccgcgaacacgtgcgtgacgacgttgacgtgttttgtttttatctggtttggaaatcacaatagtcacctctatatattagtatggacagctttacgctgcattatttaccagtcttaccttccttacgacgaacatattcatcgacgtaacgaatccctttacctttgtaaggttcaggtgaacgaacggcccgaacttcggcagcaaagtcaccaacagcttgcttaccaataccagaaatattgatatgcgtgttatcaggaacttcaacagtcaagttttcaggcgttgcgaattcaacagggtgtgagtaaccaacgcttaatactaacttcttgccttgcaattgggcacggtaaccaacaccgaccaattgaaggttcttagtaaagcctttagtaaccccttcaaccatgttgttaacatttgcacgggtagtaccgtgtaatgccttcatcttgtagtcatcagatggacgagtgaatttaacttcgttgccttcaaccgtcatcgtaatatcactggcgatgttccgcgttaaagtacccttaggacccttaaccgtaacgacttcaccagcttgtgatacttctaccccagcaggtagttcaattactttataaccaatacgactcacttacttgcacctcccgtcttaattaatgattaccaaacgtaagctaatacttcgccgccaagcttcttggcgcgagcttctttatcagtaatgacaccttctgaagttgagatgatagcaatccctaaaccgtttaaaaccttaggaacagcatcagccttgacgtatgaacgtaaacctggctttgaaatacgcttcaagccactgattacacgttcgttgtccttaccatacttcaagaagacgcggatgatgccctgtttgtcatcatcgatgtattcaacgtcgcgaacaaaaccttcattctttaaaatttcagcaatgttgcgtttgatttttgatgcaggaacttctaatgaatcgtggcgtaccatgttagcgttacggatacgagtcaagaaatctgcgattggatcagtcatcatgaaagtttaacctcctttaacttgggtttgtttttaccagctggcctttttcataccagggatttgacctttgtgggccaggtcgcgtaagcagatacggcacaagtggaatttacggtaaactgaatgtggacgaccacaacgttcacaacgggtgtagttttgtacgttaaacttagcaccgcgcttttgtttagcaatttgtgattttttagccaacttcgattaacccccttcggttatttagcaaatggcatgccaaattgagttaacaactcacgtgattcttcatcactatcagctgtcgtaacgattacaatgtctaaaccgcgaacacggttaacattatcatagttgatttctgggaagatcaattgttcacggacacccaatgtgtagttaccgcgaccatcaaatgaacgagtacttacaccatggaagtcacgaacacgtggtaatgaaacattgatcaacttgtccaagaagtcatacatacgttcgccacgtaagtcaaccttggcaccaattgccataccttcacgaagacggaaaccagcgatagacttctttgcccgggtaaccaatggtttttgaccggcgatcaaagttaattcttcaactgcttcgtctaagtttttagcgttggtaactgcatcaccaacacccatgttcaaaacgatcttagccagcttaggcacttgcattactgaagtgtaattgaacttgtcaactaatgctggaacgatttctttttcatattgagcttttaaacggttttccatgaaacttgcttcctcctttcagtcagtcttagttttctaagtctttaccagactttttagcgtaacggacacgcttgccatcttcacgacgaacacctaaacgtgtaggttcgttggttgatggatcaaggtacataacgttagaagcatcgattggtgcttcgatgtccacgattccgccttgtgggttaacgttcgttggcttttggtgtttcttgatcttgttaacaccttcaacaacgatccggttcttggcagagataacctttttaacagtaccttcttgaccacgatccttaccgctgattactcgaactttatcaccagttttaatcaacattaggttgcgcacctccttatttacggtgtgtgactagagtacttctggcgctaatgaaacaatacgcatgaagtccttatcacgtaattcacgagcgacaggtccaaagatacgagtaccttgtggagtcttgtcatcacgaataataactgcagcattttcatcaaacttgatgtatgaaccgtcagcacggtgaacaccagacttagtccggacgatcacagctttaacgacatcatgagctttgacaacaccaccgggtgttgcttgtttaaccgtagcaacaatgacatcaccaatgttagcagttttacgaccagagccacctaataccttaatagtaaggatttcacgggcaccggagttgtcagcaacttttaaacgactttcttgttggatcacagtaagtgtcctcccttcgtgtaattttattcagctaataatctagataataacagctttttgaacaacttcaattaagcggaaacgcttagtagctgatagaggacgagtttccatgatcttgacgatatcgccaattttggcttcattcttttcatcatgagccttgaatttctttgaataacgaacacgtttgccgtataccggatggttcttgtaagtttcgacaataacaacaatggtcttgtccatcttgtcagaaacaacgcgtccttggataaccttacggctgttacgagtatcttcactcattcgtgattgcctcctttatactctacttgtttaactcttgttcacgcaacgcagttttaatgcgcgcaatgttcttacgaacttgttttaaacgagcggtgttttcaagctgaccagtggccaattgaaaacgcaagttgaaaagttcgtctttgtaagacttttctttttcgagcatttcagtagtggacaatgctttaatttccttagccttcatctgattcgccacctacttcctcacgcttaacaatcttagttttaacaggtaatttagttccagccaagcgtaaagcttcgcgtgcaacttcttctggaacaccagcaacttcaaacataatcttgttacgtttaactggtgctacccaacctgcaggagtacctttcccattacccatccggacaccaacacctttttcagtgtaggacttgtgagggaaaatcttaatccataccttaccgccacgcttcatgtaacggttcatagcaacacgggcagcttcaatctgccggttgctgatccagtgtgattcgagggtttgtaaaccgtaatcaccaaaagcaactgttttaccgcctttagcttcaccgcgcattttaccacgatgaacacgacgatacttaacccgtttaggtaccagcatgtttagtttcctcctttagcagatttcttttctggcaagatttcgccacggtaaatccaggtcttaacacctaacttaccgtaagtcgtccgtgcttcgacccatgaatagtcgatgtcagcacgaagcgtatgcaatggaaccgtaccatctgagtatgcttcaacacgagacatgtcggcaccgtttaaacggccagcaacttgtgtcttaatacccttagcaccggaacgcattgtacgttgcatagcaccacgcatcgcacgacggaaagcaacccggccttccaattgacgcgcaatactttcaccaactaatttagcatctaaatcaggcttcttgatttcgatgatgttgatgtgtactcgcttaccagttaaattgtttaattctttacgaagagcttcaacttcagaaccacccttaccaataaccatccctggttttgcggtatggattgaaatgtttacgcggtttgcagcgcgttcgatttcaacggtggagacggaagcgtcggcaagtcgttgttcgatatacttacggatgcgtaaatcttcgttcaagtaggcagcaaaatctttttcagcgtaccattttgcttcccagtcgcgaatgattcctacacgtaatccggttggatttactttttgacccacgcgttatccctcctatttttcagtaactgtgatcgtaatgtggctagtccgcttgttgattggtgaagcagaaccctttgcccgtggacggaaccgttttaaggttggtccttcgttaacaaaagcttcgcttacgaccaaatcttcgcgatctaagtcaaagttattttcagcgttagcaacagcagaaagtaagaccttttctactacaggagaagcaccccgtggagtgaacttcaagattgctaaggcttcggcaacacttttacctctgataagatcgacaactaggcggaccttacgagcggcaatacgaacagtttttgcagttgcacgtgcagatgttacttgttcagccattctttatatcctcctaactattacttcgttttcttatcgtcagttccatgaccatggaacgtccgtgttggtacaaattcacctaacttatgaccgaccatgtcgtcttggatgtaaactgggacatgcttgcgaccatcataaacagcgattgtgtacccaatgaaacttgggaaaattgttgaacgacgtgaccacgtcttgatgacagatttcttgtcagaatcagattgtgcatcgattttctttaataaatgcgcatctgcgaaaggtcccttctttaaactacgacccatcgtgtgacctcctctcgataactacagtaaattcaaattttattagtgtttgcctggacggcgaccacgaacgataagcttgtttgaacgagccttcttgttccgagtcttcttaccaagcgtcttcttaccccatggagacattggagatggatgaccgattggtgctttaccttcaccaccaccatgagggtgatcgttagggttcattacagaaccacgaacagttgggcgcttaccttgccaacgtgtacgaccggctttacctgagttgattaattcgtgttgttcattaccaacagtaccaacagtagcacggctagttaataatactaaacgaacttcaccagaagacaaacgaacaatggcgtacttgccttccttacccagtaattgtgctgaagtaccagcagagcgagctaattggccacccttacctggcttcaattcaatgttgtgaataacagtaccaacaggaatgttagttaatggtaatgcgttaccaaccttgatgtcggcttcggcacctgattgaacttgcataccaacttccaaaccttttggtgctaagatatatgatttcacaccgtcagcgtaaactaataatgcaatgttagctgtccggttaggatcatattcgattgccttaacggttgctggaacttcatccttaatccgcttaaagtcaaccaaacggtattgttgcttatgaccgccgccacgatgacgaacagtaatgtgaccataactgttacgaccggcagtgtgactttgtgagtctaataatgacttttcaggcttcgtcttagtgatttcagagaaatctgaagcagtcatattacgacggccgttagtggttggtttatacttcttaatacccactagagttacctcctaaattagatttattgttgatcgtcgttgaacaacttgatttcgttagaatcagaacttaaggtaacaatagccttacgacgcttcttagtgtagccggcgtaacgaccttggcgcttaagttttcctttaacgttcataacgttcactttaacgactttaacatcgaagatttcttcgattgcttttttaacttgggttttcgttgcctgtacgttgacatcaaatgtgtagcgcttgtcgtccaagtcagccattgatgcttcagtaactacaggacgtaaaattacatcgcgtgcttccattatgcgagcgcctcctctaattgatcgagggctttttgggtaacgactaatttgtcactattagcgacatctaagacgttaacacctttggctttaaggatcttaacatttggtaagttacgacctgccaaagcagccttttcattgtcctcttcaaccaaaacaagagtcttggtatcgacgttgaggttgtttaatacatttacaaaatccttagtctttggtgcgtcgaaagctaagctatcaactgcaactaagctgttgtctaagaccttttgtgaaaggacagacttcaaagctaagcgcataaccttcttaggtaatttgtaactgtatgaacgaggggttggtccgaagacaatcccacctttacgccattgtggtgaacggatagaaccttgacgcgcacgaccagtacccttttgacgccatggtttacgaccaccaccgcgacgagcactacggttcttaactgcgtgagttccttgacgcattgatgcacgttgcatcaagatggcatcaaaaaccacgttttcgtttggttcaacaccaaacacagcgtcgttcaaagtaacgtcaccattttgcgtaccgtcttgtttaaataatgctacgctagtcatgtattatgtcctccttccttatttactcttaacagatgttttaactgttacaaatgatttgttggcgccagggacattccctttaattaataaaacgttgttttcaacgtcggcacgaacgatttgtaagttttgcatcgtacgttggcgattacccatccggcctggtaatttcttacctttgaatacccggttgatgatggcacccattgaaccaggacgacgatggtaacgagaaccgtgagccattggtccacgactttggccgtccttatggatattaccttggtaaccatgacctttagtgatacccgtaacgtcaacggcgtcgccagctgcgaaaatatccgctttgacttcgtcacctactgtgtaatctccaagctcaacattacgaatttcacgaatgaagcgcttaggagtcgtttttgcttttgctgcatgaccttgagcaggtttgttcgtcaagacttcgcgtttgtcgtcaacacctaattggattgcttcgtaaccgtcattttcaacggtcttaacttgcaacacaacgttaggttgaacttcaacaactgtaacgggaactaattcgccgctttcagtgaagacttgcgtcattcctacctttttccctaagattcctttagtggtcatgagtacacctccaattaattgattttagttttgtaaattaaagcttgatttcaatatctacaccgctaggcaagtctaacttcattaatgagtcgaccgtcttaggcgttgggttaacgatatcgattaaccgcttgtgagtccgcatttcgaattgttcacgtgagtccttaaacttatgtggtgaacgtagaacggtatagatagtccgttcagtaggcaatggaataggacctgaaatagtagcaccagttctctttgccgtttcgacaatcttgtcagctgactgatcaagaatgcggtgttcgtatgcctttaagcgaatacgaattttttgctttgccattgttgtgacctccttcgtctattttgaaaataagactagctccgtgaaaattaccgccacgtcccatgacaatgtggccgggcgtgtcgcaacctttcacatcaaagctaactacgactacttgatgatggggatatagttatccccttctaaataccaagcacaatctataataaatgaaaagctctgtaatagcaagtgttttcgcactttttttataaccatcgttgtaaaccgtgttaccttttttgaaccagctcaattaatgtaacacaaattccatccaattaatagcgtttgcccctaatttctttttggggagcgctttacatttctcactgccgacctgctacgttcactatgtcccgctctagatcacactggcaccttctcagggccgacctaagcttgagatcccatcgcttttatcatcggatcatttaaccgccctcagtgcgtgattatgccgcttctttcgtgctgagccggccccttactcgctaacttgttcatctaccttctattatagtgtcatctgttaccattactcgactgtatgcacggcaaaccgccagctcggatgctggctgccgataaaaaaaggaactcgatagtcgagttccacttatcatgccatcgccctgcacgcttaatgtgaaggttgcatgatcttatgggtcgccgctgcaagtgattcaactagtgtgaccccttgttgcatagttgcatcttgattcgtatagattgcaatgacgtagccctgaggatcacgatgcttgtcatagacgtgcccaatgctattgacctgccatcccaaaccattatcactcagatccatccagccattctttaattggtagtcgggtgcatcctttgagacgccccagctctgttcatgactgactgttcccattagattctgaatgtagtgtttcgagcgactcgtcaggtaattggaaggatagtagatggtacgcaataatttcacttgatcggctggcgtcgtcttcgtcatactccacgaagtcaagttagccgtcgtatgtgtcatttgcaagttctggtataagttattgagcgcaccgtaactgcctaagccattgctcagtaaacctgtcgccgcattgttatcgctatagcggatcatcgactcggccagagtctgttcacctgatgtgaacgttaactgcccccggtcgcgctgatgtaacagttctgttaaaatactagccttgatcgtgctggcaacgtaatacccgctaccgtccgtatctcgattgtacgtcacactctgcttgctgcgcggtgaatagatggcaatccctactttgacggactggtgatcaataattttttgccaagcggctaataactgttgccgttgctgtttcggatcaacggccgttaccttctccgatgagttggccgtcgcttttggctcagtgcctgcttttcgctccgccttcacctgatgttgcggcgctattttgcttgcctgataattagaaaatgaaccaaggacgactaaacaaatcacggccacactgaccagtaattgtcggtgatagccacccacgcggcgggtcagccactgataccctgcatagtcgaccatcgcaattattaacgccagtggtaacacgctgagggcacgcccaggacgagtcgcaccatctagtagccacactaacgcccagtaatataaataccacaagtaggtcgtcatcagaagatgccattggcgcacgttcactttcatcggttgaacggtccacaacaaccagccactccccaaacacccaattactaaccatactagttgtagccagtgattttgaaaagtcgcactgtgaccaccaatcatgaatagaactgcataacaaatcagtgcaaagaccgtatcaagtggcccacgctgaatcgcgggagacgtgacgcgtccgtgatgccaagcgacgatcaacccgccaactgcaaacgatagtaagaataaactggtgggcagcccgcgactgaaacgcgtgaacaaccagccactgttgatgaccaacgcgaataaagccaagcaaccgttgctgaagataagcgtctgccgaatcggcagttgccggtactcggcaatttgtacggttacacgcagccacagtaagccaatcacgtagacgacgaccggccaaagatgaaagaagacgttgtgcatcgtggccgcatcgaccggtaacgaccaaataatggtccgcaatggctgtgtggccgccccatacagatgttcaaaagatggttcaacgacccagcttacagctaacacaagaaccagcagaaccaataagctctgtaagatgaacacgacctcgttaataactgagaaacgtgattccgtttgccttggcgccaaccagtgctcggtcataatgccacctaatagtgccatcacaagcgtaaaactgacaacttccccattgatactcgggagtatctgactgattcccacgagtatcaccccaacaaaacctaacccgtaccacttattcataaacatgagtgactcctccacgggtgattagatattaatacagagaatatcttaccataattaattagttattagtacgtacttaccagcaattttggggccacttggattgacataccatgccatcctgcgacacgtcgcaaccgtgttttggttatcaataaacttatgtaaaaaaagacgtccagccgaagctgaacgtctttcttattatcaatcaagcttatttggcaggagtgccgccattcttcttgatgatatcttcttgaactgactttggtaccttttcgtaatgatcaaaggtcattgtgaaagtcccacgaccttgagtagctgaacgtaatgtggttgcataaccaaacatttcagccaaaggaacgtatgcatgaacttcttgggcattcccacgttcttccataccttcgatgttaccacgacgagcagtaacgtgacccataacatcacctaagtaatcttctggggcaacgatatcaaccttcatgataggttcaaggataacagggccagcagtcttaacagcattccgcaatgctaatgatgcggcaatcttgaaggctgcttcactagaatcgacatcatggtaagaaccatcatagagcttagccttaacgtcaaccaaaggataaccagctaacacaccgttagccatagcttccttcaaaccttgttcaactgaaggaatgtattcgcgaggaacaaccccaccgacgatggcatcttcgaattcgaagcctttaccttcttcgttaggtgtaaattcaatccaaacatccccatattgacctttaccaccagattggtgaacgaacttaccttgaacttgagtgctcttagtaaaggtttcacggtatgaaacttgaggcgcaccaacagtggcttcaacgttaaattcacgccgcatccggtcaacgatgatatccaaatgcaattcacccatcccggcgatcaaagtttcaccagtttcagggttagtttcagccttgaaagtaggatcttcttcagaaagtttttgtaaggcaacgttcatcttatcttggtcagccttagtcttaggttcaacggcaacctggataactgggtcagggaattccattgattccaagtgatatggatggtcaatcgaagtcaatgagtcaccagtagtcgtgttcttcaaaccaattgcagcggcgatatcaccagagaaaacttctgggatttctttccgttggttagaatgcatttgaagtaaacgaccaacccgttcacgtttgtccttagtagcgttcaagacatatgaaccagattccaaagtaccttggtatacccggatgaaagtcaaacgaccaacgaatgggtcagtagcaaccttaaatgctaaggcagcgaatggcttatcatcaccggcaatcaagtcaacttcttcttcagtttcaggatcagtagccttgtatggcttaacatcaagtggtgatggtaagtagtccacaacggcatccattaacatttgaacacccttgttcttgaaggctgaaccagctaatactgggaagaattcaagtgctaacgttcctttacggatagcagccttaatttcttctttgctgatttcttcaccgccaaggtacttttccatgatgccgtcatcgatgtcagctaaggcttcgattaagtcatcacgtgcagcttgggcttcttctttgtattcatcaggaacgtcaaccgtatcccattcagtaccaagttgatcttcatcataaaggtcagccttcatttcgattaagtcaatgaccccttcgaaattatcttcggcaccaattggtaattggatggcgtgggcgttagcttgtaaacgatcatggatcgtgcttacagagtacttgaagtccgcaccaatcttgtccatcttgttaacgaaaacgatccggggaacgttatacgttgatgcttgacgccaaactgtttcagtttgaggttcaacacctgattgggcatccaatacggcgatcgcaccatctaaaacccgaagtgaacgttcaacttcaacagtgaagtcaacgtgccctggggtatcgatgatgttaatccggtggttcttccactgtgcagtcgtggcagcagaggtaatggtgatcccacgttcttgttcttgggccatccagtccatttgtgaagcaccatcatgggtttcaccaattttgtgaattttaccagtgtagtacaagatccgttcagtagtcgtggtcttaccagcatcgatatgggccataataccaatattacgggtcttatcgagtgagaattctcgtgtattagccattagaaaatgtgttactcctctcaatataaatggaattaacagtataaagtttatttcaaaaaatgactactatatgcgcgcatataatagtcacctttttgtgattagttaaaggcgacctttaaccatctcacggaaatattaccaacgataatgggcgaaggcacggttggcttcagccatccggtgagtatcttcacgcttcttaactgaagcaccagtattgttagcagcatccatgatttcacgagctaaccggtcggacatagtgtgttcgccacgtgagcgagcatattgaacgagccaacgaaggccaagcgtcgttttacgatctgggcgaacttcgattggaacttggtagttagaaccaccaacacggcgggccttaacttcaagtactggcataacgttcttcatagcttcttcgaagacttccaaaggatcgttaccagtttgttctttgatttgatcaaaagcatcatacaaaatagttgatgcggtaccgcgcttaccatctaacattaagtggttaattaaacgcgttactaatttagagttatacattggatctgctaaaacttcgcgttttgcaggtgcaccttttcttggcatttaacttacctccttattatttctttggcttcttggtaccatacttggaacggctttggcgacgatcttcgacaccagcagtatccaaagcaccacggataacatggtaacgaacaccaggtaaatccttaacacgaccaccacgaattaagacaacgctatgttcttggaggttatgaccaataccaggaatgtaagctgtaacttcgattaagttagataaacgtacacgggcatacttccgtaaagccgagttaggcttcttaggagtcatggtaccgacacgagtagcaaccccacgtttttgtggcgctgggttattagttgcaaccttcttgtaactgttatacccaaagtttaacgctggggcatttgattttgatactttagacttacggcctttgcgaattaattgattaattgttggcatgttctaaagtgtcctccttccaaatatctgtttttaagtccacacacccaggtggttcttttttgagtaaaaaagaattcctggtgcgtggttattgtgcgcttagccgaccagtcagcatgtctgtattcctgatacaggaatctgtctgcaaaaagcacctttactagactatcatgacatgccgaagttgtcaataaatgtcataaaaaaatacgcgtcgtcctcattacgtacctagtgatgaaaggtggtcctgaccatgttaaccagcagtctttttattctcggcctctgcctgggctcattcgtgacctgtatggcggagcgcatcagcagcggacacacactcattagtacccaacggtcactgtgtccgcactgccggcaccaattacggttctggcaactaataccattgcttggtattctgcttcaacgggggcgttgctatgactgccacgccccaatcaaccttcgttctagtctgattgaattgctctgtggcggtttactggcttctagcggtgcgtcattttcattgacactgccactcctgatgggctacctggtgttgattttcaatagtcttactgattatctcacttttgaagtctatccgctaacattgattcttccggccggattgggcttgtggcagcaacgaccacccctgacgctcagtctctacctcgtacttgccttactagtcggactatacctgctggcccggctaacggccacctttggcctcggcgatgttgacatcctactcatgctcgtcttcatcattcctgccgaaacactgctgacctgcctcgccattgcagccgttgccgcactagttggttttatcatcagtgccccccgccaccgcctaccgttcgtccccttcatcagctggagttttatcatggtcacccaactcacgggtctcgcatagacaccgctgatgcgagcatggattgaagcgttcttattaaacctgattattgctcttcagcccatgagcgccctatgccgacctccgataataatgagccgccacttaacttgatacaattggtcagtaagtcatttaccacttggcattcggccttggaaggccagtattcaaaacgtgggttcagcttgaatcgatggccaccgcccacttggcagaaggactggaaaagcggctcagagaaaccaaccgagcacccctacacgaatttaggccgtttgtagcattttatagctggtatttctcctgaagactactccctcatcgacgaccagatgtgggtgtttgacctataatcgtgcacacaaaaaggacgaccacaatggccgcccttttttagctgcttaacaattacttgctagcatcttgttcttgcatttgtttttcaaggtcgctgattgagtaaaccccatcagccacgttgccaacttcctttggcttgatatgacggtaaaccggcataccagtcccagcaggaatgatcttaccaatgataacattttccttaagaccgatcagtggatcgttcttaccacgaatagcagcatcagttaagacccgtgtcgtttcctggaatgaagcagctgacaagaaactattcgtttcaagagcggctttggtaatcccaagaatgactggccgtgacgttgcaggaataccaccggcaatcaaggtcttgtagttctcgtccttgaagtctgcaatatccattaacgtcccaggcaagacgtcggtatcgcccggatccatgacccgaaccttccgtaacatttgccgaatcatgatttcaacgtgcttatcgccaatttcaaccccttgcatccgataaaccttttgaacttcacggagcaagtagttttcagttgataagacatcacgcacttgaattaattgcttaggatcaattgacccaatgttcaacgcagcaccacggtgaataaagtcgccttcactaaccgccatccgtgctgttaacggcaacgtgtaagtccgggtatcagtttcacccttaaccgtaacttccttcgtccgttccgctggattttcttcaattaattcaaccgtcccagtaacttctgagatttcggcacgccctttaggattccgtgattccacaatttcttgcacacgaggcaacccttgggtaatatcgtccccggcaacaccaccggtatggaagttccgcatggtaagctgagtaccgggttcaccgatagactgtgcggcaactgtcccaacagcttcaccaacttcgacttcatcaccagtagccatgttacggccgtagcaatgttcacaaaccccatgcttagtgttgcaagtaaatgcagaacggatcgtaacttccgttacaccagcatccacgattttatgagctaagtcttcgtcgatcaagacgttgttaccaacaatttcatcatgcgtttcaggatcaaagacagtcttcatcgtgtaacgacctaagatccggtcatacaacggttcgatgacttcgttaccttccatgattgcgtgaatccgcaacccacggtcagtcccacaatccttttcacgaacgataacatcttgagccacatcaaccagacgccgagtcaagtaacctgagttggcagtcttaagcgccgtatcggtcatccctttacgagcaccgtgggttgaaatgaacatttccaagacagacaaaccttcacggaagtttgaaaggattggtaattccatgatcttaccgttaggggcagccatcaaaccacgcatcccagctaactgagtaaagtttgaaatgttaccacgcgcaccagaatcactcatcataaagattgggttatccgcgttgaaactttcaatcagtttttgttggatttggtccttagcgtcgttccagacaccaatgacccgttcataacgttcgtcatcagtaattaaaccacgacggaactgttttgaaatcgtattaacttgtttatgggcttcggcgataattgctggtttttctttcaaaccagtaatatcggcaaccccaaccgtcaaaccagacttagttgaaatgttgtaacctaagtccttcatccggtcaagcaagagtgacgttgctgtcacgtgatattgcttgtaaacttcagcgataatgtcggccaagaagcccttcttgaatggtggaatgatttcctgggcatccaagaattgatgaatatcttcaccaggcttcaagaaatacttgtccggtgtaccagcaatcaagttatcgttagttggttcgttcaagtaagggaacttgccaggcaaaatgtcgttgaagattgccttaccaaccgtcgtgactaagactgcttgcttctgatcgtccgtgaatggcttgtcaggcattgatgagacctgaatgccgacccggctatgcaaatgtacataacctgattggtaagccttttgcgcttcattcaagtccttgaagatcataccttcgccttcacgaccgatttcttcagtcgtcaagtagtagttaccgataaccatatcttgagatggcgtaacaacgggtttcccgtccttaggcgccaaaatatggtgggcagccaacattaagagccgtgcttcagcttgggcttcatctgaaagtgggacgtgaatagccatttggtccccatcgaaatcggcgttgtaagcttcacaagccaatggatggagccgcatcgctttaccactaaccaagacgggttcgaaagcttgaatccctaaacggtgaagcgtaggggcgcggttcaagagaacaggatgttccttgataacgtcttccaacacaccccagacatcgtcatcagcatgttcgatctttcgcttagcattcttgatgttagaagctaattcacgtttaaccaattccttcatgataaacggtttgaacaattccaacgccatttgacgtggtaagcccatttggttcatcttcaagaaaggcccaacatcgataaccgaacgaccagaatagtcaacccgcttaccaagtaagttttgacggaaccgcccttgcttccctttcaacatgtgtgaaagagacttcaatggccggttaccaggaccagcaacgggacggccacgacgaccattatcgatcaacgcatcaacggcttcttgcaacatccgcttttcgttttgcacgataatcccaggtgcatttaagtccaacaagcgtttcaaccggttattacggttgataacccgccggtacaagtcgttcaagtcagaggtggcaaaacgaccaccttccaattgaaccattggccgtaagtccgggggaataaccggaattgcgtccattaccatccaagctggttcgttaccagatgttacgaaagcttcgatgatatcaagccgccgaacggcccgggtccgcttctgaccagaagcatccttcagagtttcctttaaatcacgtgcttctttttcaagatccacgttattcaataaccgtttgatagcttcggcacccatggcagcttcgaattcgttaccatattgggccttcttctcacggtattcacgttcagaaagtaattgcttcttttcaagcggcgtattaccagattcgataacgacgtatgaagcgaagtaaatgatttcttcaagtgcccggggactcatgtctaagactaagcccatccggctaggaattcccttaaagtaccagatgtgagtaactggtgcggcaagttcgatatgacccatccgttcacgacggactttactacgagtcacttcgaccccacaacggtcacagacaatacccttataacgaatccgtttgtatttaccacaagcacattcccaatccttagtaggaccaaaaatccgttcgtcaaacagaccgtctttttcaggtttcaatgtccggtagttaatggtttctggctttttgacttcgccatatgaccagctgcgaatcttgtctggggatgccagaccgatttgcatgctttcaaacttgttgacatcgatcaaaggaccgacctccctttttattgattatcttgctgagcgttggttgtttcagaaggcttagcggcgtcagcttttgcggccttgtccgcagccttctcatcttgttgttgtttaaacttgctgagtgcatcgacattgacaacttcatcgtcatcatcatccatgtcccgcaattcgatttctttgtcttcagaatccaagactttcatgtcaagaccgagtgcttgcaattccttaaccaacacgcggaatgattccggtacgccaggctttggaattggttcgcccttaacgattgcttcataggtcttaacccgaccaacaacgtcatcggacttgtaagtcaagatttcctgcaaggtataagctgcaccataagcttccaaggcccaaacttccatttcaccgaaacgttggcccccaaattgcgctttcccaccaagtggttgttgcgtaaccaaagagtaaggtccgattgaacgagcatggatcttatcgtcaaccatgtgactaagcttcatgtagtgcatgaccccaacagcgacccgcttatcgaacggttcaccagtccgaccatcatagacgatcgacttggcatctgaatcaaccccagcttcacgaatggcttcccaaatatctgtatcttgcgcaccatcaaagacaggcgttgccatgtgaattcctaacttccgagcagccatccccaaatgcaattcgagcacttgcccgatattcatacgagaaggcacacccattgggcttaacatgatatcgattggtgtcccatcaggcatgtacggcatgtcttcttcaggaaccacgattgaaaccgtccctttgttaccatgccgaccggccatcttgtcaccaacttggatcttccgcttttgtgcgatgtagacccgaaccatcatgttaacgccaggagataattcatcaccgttttcacgagtgaagatcttaacgtcctggatgataccgccgccaccatgaggaacccggagtgacgtatcccgaacttcacgcgccttttcaccaaagatcgcatggagaagccgttcttcagctgacaattccgtaacccctttaggcgttaccttaccaaccaagatgtcaccgtctttaacttcggccccaatccggataatcccgtcttcgtcaaggttcttcaatgcatcttccccgacgttaggaatttcacgagtcatttcttcaggtccaagcttggtgtcacgtgcttctgattcatattcttcaatatgaattgacgtgtaaacgtcttcacggactaaacgttcattaataatgatggcatcttcgaagttataaccattccaagtcatgaaagcaactaatgggttttgcccaagggctaattccccaccttccattgctggaccatcggctaagacttcatcgttatcaacgtgatcgccaactttaacgattggccgttggttatagttcttaccaccgttagaacgacggaatttcattaacttgtaagtgtctaatgaaccatcatcgcgacgaacgcgaacttcgcgagcatcaacgtattcaaccgttccttcatgacgacaaatcaaggcaatccctgagtcatgtgcagctttatattcaatccccgtcccaattaatggcgcgtgaggatcaagtaacggcaccgcttgtcgttgcatgttggcacccatcaaagcacggttagagtcatcgttttccaagaaaggaatacatgccgttgcgacggcaaccacttgtttaggcgaaacgtccatgtaatcgacattttcgattggcgtttccaagttttcttccttgttacgagctaaaacagtatcttcaacgaaagaaccatcatcattcaatggagagttggcttgtgcaatcacaaattggtcttcttcatcggctgctaagtagtcgatcttatcggtaaccttatgcgttgtccaatcgacacgccggtatggcgtttcgatgaagccgtaacggttgaccttcgcataagaagacaaactgttgatcaaaccaatgttagggccttcaggcgtttcgattgggcacatccgaccgtagtgggtatagtgcacgtcacgaacttcatatccggcccgatcacgagtcaaaccaccaggtcctaaggctgataaacgccgcttatgcgttaattcacctaaggggttggtttggtccatgaattgtgacaattgtgatgacccaaagaattccttaattgaagcaaccactgggcgaatgttaatcaattgttgtggcgttaccgtcgcagcatcttgaatcgacatccgttcacgcacaacccgttccatccgggataacccaatccggaattggttttgcaataattcacccacggaacgaatccgccggttacccaagtgatcaatatcatcggttgagccaagaccttcttgcaagttgaagaagtaattaatggaagcaatgatatcagcaggcacaatgtgcttgaacttcaaatcaatgttgccattaccaatcacgttcacaaccttttcagggtcgttttgtgaataaaccttaacaacttgtaagaccattggattcgtaacaacggcttcgtcagatggtgtgtaagtaaccgtcttaaagtcgtcacgttccaagtatggggatagtttagccatgacattcttgtcaatgaccgtatccttttgcgcaataacttcaccagtatcaggatcagctaatgtctcagctaacgtttggtccattaagcgcgtcttcatacttaacttcttgttgaccttgtaacgaccaactggtgcgaagtcataccgttttggatcgaagaaccgagcagtcaataggctccgcgaactgtcagccgtcttaggttcaccaggacgtagccgttcgtagatatcttttaaggattcttcaacccgggagtcgtcggtgttcttatgaacgtccttttccaacgtcaacatcaaactgtcagtttcacctaacatgtcaatgatgtcatcatcagaaccatagcctaaggcccggactaattccgtcaatggaatcttccgcgtacggtcgatccgcacgtatgagacattcttggcgtcagtttcaagttctaaccaagcaccccggttaggaataaccgttgtgccatagctaggacgcccatttttatctaattcttcattaaagtaaacgccgggtgaacgaaccaattgtgaaacaatgacccgttcggcaccgttgataataaacgtcccttgttcagtcattaatggaaaatcaccgaagaatacgtcttgcgacttaatttcaccagtttcatggttagtcaaacgtagggtaacgtgcaatggtgccgagtagttggcatcatgttcacgagcttcttcgacggtgtactttggttctaataattgatagtcgacaaattcaagtgaaagttttcctgcgaaatcgtcgatcggcataatatcttcaaacatttcccggagaccttcatccaagaaccattggtaagaatcggtctggatttcgatcaagttaggcaaatcaagaacttccttgatacgtgcataacttctacgggtacggtgtttaccgtattttactaaatgtccggccaagttgttcaccccttcttattattccagaactcgccgccttcagccaaatattacatttatgttacaaatgcatttttgaccgaattttgggcataaaaaaaccaaaaatagtcgcttaagttgactatttttggatttatattaacgagccgcacagacaatagattgcgcgttcgctcgagctcacggttacagacaagttataatatacatcgtataacgcgagttgtcaaccagtagactcatccgctggtattaattttctggttcggttgcgaccccgtataagatcatcttcaagagtgtttgtacgcgggttcgttcgtccgcatgcggatcaccaatctgatggaaactgttaaacagtgggctcaagctggtgatgtagaagttcgtcgccatctgtggcgttacccctgcgtgtaactgcatcgccggatgctcaaacacggtttgaatcggctgaacatagtcagttacgaagatgccacccaattcacggatatgttcatgtgtcaatgctttaaagctggaatggattaacgtgaagacatcagccggatgcttatgcgttagtaatagtgagacttctgttaactggtccaacggagaccaatccgtgtgtgcttggattgcttcaatccccgccttgatttccgcaccgaccgtcgtaataacggctaaaaagatgacctctttatctttaaaatggtgatagagtgcaggctgcgtaataccgattgcattcgcaatgtcacgcgtactggtcgcatcataacctttttttaaaaacagttcccgggcggtatctaaaattgcctggtgcgtcttcgccatctgttcggctcgtgtcgccatgtcatcatcttctttcttgactttatttcctattataatttacaccaatccgcaccgaaccaccagcctcagatcttgcggtttgctttaacggtgatccgttagtgccacttacgccaaaaagatgacgctcgaagcgtaacatcacttcaagcgtcatctttaagctaatcgtgcctacttcgaggaaacggtcgaacgaccatccgccttaggctggtttttaatattaatggtaatggcacccttgctagcaccaatcgtgacttggtcatcgaccttgattgcaccggtcaatagttcttcactcaaccgatcttcgatttcagtctgcaatgcccgtcgaattggccgggccccgtactcaggatcaaagcctgccttagcaaccacgtcaatggccgccggggtgattttgatcttgataccttgttgagcgacccgatcaacgatttcttgagacatcaacttaacgatttcatgtaattcttccttattcaatgaatggaagacaatcgtttcatcgatccggttcaagaattctgggcggaacgtctgcttcaatgtcgcgcggatcgtcgcagcgaccgcattgtagtcgttggccttatcagttgcaccaaaaccaacggacttctcatcacgaagcgtggtagcgccgaggttcgatgtcatgattaagatggtatttctgaagtctaccttccgacccttagaatccgtcaagtaaccgtcatccaagacttgtaacagaatgttaaagacatctggatgagctttctcaacttcatcaaacagtaccactgagtatggtttctggcgaaccttctcagtcagctgaccaccctcgtcataaccaacatagccaggtgccgagccaatcaaacgactagtcgagtagcgttccatgtattcagacatgtcgattcgaatcatgttgtcttcagacccaaacattgccgccgctaaggcctttgcaagttccgtcttaccaaccccagttggtcccaagaacataaaggaaccaattggccgacttggatctttcaagccactccgcgcacggcgaatggcccgggccactgcggataccgcttctggttgaccaacgacccgttcatgcagaatcttttccaagttaactaagcgttcgctttcagatttttgcaattgcgttaacggaacaccggtccattcggcaacgacctgagcaatatcctcacccgtgacttgtaagtcatagtgtggcgtcgtgccctcagtcatctcagcatcttggtcagcttcgattcgatctagacgttgcttgagctgcatctcctgcttacgaatatcagcggcctgttcaaagtcttgggcttcgattgccgtttctttatcctctcgcagttgcgctaacttgtcctgattcttggatagcttcgttggttgatccatctgatcgatacgaaccttggctgccgcctcatccatcaagtcaatggccttatcaggcaagaatcgatcactgatataccgactagacagcttgactgcttgatcaacagcttcatccgtaatcgtcacccgatgatgttcttcataccgtggccgtagcccatctaagatttcaacggcttcgtcttcagtcggttcattgaccatgaccgttgcaaaacgccgttctaacgcagcgtcagattcaatgtacttttgatactcatttaaagtggttgccccaatcgtttggagttcccctcgtgcaagtgcgggcttcagaatgttagaggcatcgatcgccccttcagcaccaccggcaccaatcaaggtatgcaattcatcgatgaataagatcacatggccatcgttgtagatttcatcgatcacttttttcaagcgatcttcgaattcaccacgatacttggtgccagcgactaatgagcccatatcaagcatcatcaaacgcttgtcagccatatcagttggtacatcaccagccacgatcttttgggccagaccttcagcaattgctgtcttaccaacccctggttcaccaatcaagaccggattgttcttcgtccgccgtgataggatctgaatgacgcgtttaacttccttggaacgcccgacaactggatccatttcctgttcactagcgagttgcgtcaaatcgcgcgccaaagaatccaaagttggggtgccttcggtcttcttaccaccgcggttagccgcattacccttgcgcttactcatagcgtcactgacacctagcttgcgaagtacgactttccgggtctgaccaaggtctaagtttaagttcattaaaattcgcgaggaaaggatactttcatcagagagcatcgctaacaacaagtgttccgttccaatcttgttggcaccgagccgttttgcttcatcaccggcaacggacaaaatttctttggcctttggtgaatatggcaagtaagtatccttgccaacattgctcaacgtcccatagccagtgaaccgttcgatctcttctcgaatatcatcttcactaacggcatattgttgtagcaccttattcgcaattccattcttttcgatggccaatgctaatagcaaatgctccgtaccaactgcctgatgcttgaaatatttggcctgttcctgtgccagtaccagcacacttttggcactaggtgtaaataagttatccattgcgattcctcgctttctttagctttcgtaacgcaagtggttcaagattccgataattatccgggcccgcagactgttttctaagtcccggtccgttaatcctaacgtctcgtggtcaatcgccactaaaatcaattgcgcttctcgacgatttaagacgtcgtcctcgtataaactttggacgaccgcataagcatctcgttgtgtgattgaatcgccgatcacctgtatgagggcgtccaacacatcagcatcatcgaccaaattaaccttctcaatgcgaatataaccaccaccgccacgtttactttcaactaagtaaccattttggatcgtaaaccgggtcttaatcacataattaatctgtgagggtaccacgttgaaaaggtcggcaatttctgaccgtcgaatttcaacatgctccgagtccgccaaaatactttttaaatacttttcaataatatccgagatattttgactttgcatgtgcttcacccttttcattatctttgactaatattgactattattatacgaggataatggaaaaaagcaaagaatttcacccaaaccgcggactagcatgtgcttaacggttgttacagcatagcacgccaaacgtttgctttcaattgattcaaccgtttagaacctcataatgattaaattattaggtctccatattcattgaactacctatttaaaatatgtcaagttgagtcactcctcattgcaggcgatgggcactggtatcacaacgatgaacagcagttccgagactaatttctccgagctcatgactaacagtggctgttgccttgtcgggattatgagtcacaaccaccgtattcttcacatggctgacttagtgagtaacgtcgcaaaagtgtcccctgaccgttgaaacacccctgcttacaaaaaaggccataaaaaaatccagccaaatgactggattagttggtttaaccgtaatcgggaaaacaggatttgaacctgcgacccctacgtcccgaacgtagtgctctaccaagctgagctacttcccgagaaaattaaataaaaagccttagcacttaactaagactgtgttaaacgatcgggaaaacaggattcgaacctgcgaccccctggtcccaaaccaggtgctctaccaagctgagctatttcccgatactaatgcacccagtaggagtcgaacctacaaccttctgattcgtagtcagacactctatccaattgcgctatgggtgcttatttaaaatgccgaggaccgggatcgaaccggtacggttatcactaaccgcaggattttaagtcctgtgcgtctgccaattccgccaccccggcaaattaaaagcggaagacgggattcgaacccgcgacccccaccatggcaaggtgatgttctaccactgaactacttccgcataataaagctattaaattgtaaatgccgactagaggattcgaacctccgacctcctcattactagtgagatgctctgccaactgagctaagtcggcatgtgcgggtgaagggactcgaacccccacgtcgtaagacactagaacctaaatctagcgcgtctgccagttccgccacacccgcatgatgttaatcatgccttgttgccggttcaaacagttcttactggtatgccttgacaactatttaactttatcatcatgttgaatacttgtcaacaacttttttcaaataaatggataaatatactttttactggataaacaagttatatttttccgacaagaaatattatagcacggtagccgaaaatagcaaaccctattttcaaaaaaaggtgaataaatttcagtaaacccagctttttcgcccttttgcgcctgaaatgttgtcccaacattctgcccgtcccgcaattatttagtcaactcggccgttatttccactcacattttaaaatcgacagttccttttaatactcattaattatgcaaaaaaagcgaactcgcatcactgcgagttcgctaacttcatctcaattaaccttgtttttcaatcttggtcttaccgtgcatatatggtactaatacgtcaggaatcgtaaccgttccatcttcattttgatagttttccaaaatggccgcaacggtccggccgacagccaaaccacttccgttcaaggtatgaacgaattgcaacttgccatcgtcatcccgatattgaatgtgtgcccgccgagcttggaaatcagtacaatttgaacaacttgaaatttcccggtacttgtcttgttctgggaaccaaacttccaagtcatgcgtcatggccgccgtaaagctcatgtcacccgtcgttaacgtaataacgtggtatggtaacccaagctttttcagcaatgattcagcattgttggtcagcttctctagttcatcccatgaatcttctggtttcgtgaacttaaccatttcaaccttgttgaattggtgtaagcgaatcaagcctttcgtatcacgaccagcactaccagcttcttcacgaaaggctggtgataaggcggtgaagtaaactggtaatttttcggctggaataacttcatcacgataatagttgaccaatggcacctcggctgttggaatcaacgttaagtcttgcgtcgtgattcggaaagcatcttccttgaacttcggaaattggccggtaccgtacatggattcgtcagttaccatgtatggtggcaagacttccgtatacccttcagcttcgtgttggtccaagaagaagttgtaaacggcacgttccagcttggcaccatcgcccacgtagtacaagaaacgactaccagaaaccttggcaccacgttcaaaatctaagatacctaaatcctcaccgatatcccaatgtgctttcggcgtaaagtcaaaatgccgtggcgtcccgattcggcgtaattcaacggcgtcttcttcttttaagctaactggcacgtcgggatggggcatgtttggcaaatgtgcagccatatcctgaacttgggcatcaactgtccgccgttcttcatccaacgctttcacatcggcactaactttttgcatttctgcaatctcagcactagcgtcttccttgttccgcttcttctgtgagatttcacccgaaacttggttacgcgttgacttcaattgttcgctcttagcgatcaattcacgacgcttttcatcagcagccaataaatcatcgatgtcactcgcagcaacaccccgatgaccaagctgttctttcacgaaatctgggttttgacgaatcatcttaacatctaacataacgacgtctccttcttactttttatcgtaaataaaaacagtctctcctcccaattgggacgaagagactgcgattcgcggtaccacccaagttcaggatcatgattaatcccacccttaaacggataacggccgtgccgtgcagtattacctgcccacattgtcgcgccggagtttcgactgccggttcacaccacccaccggttctctgaacgtctacttaaaaacgcgccgtgtttaatattcactgtctactatagagcattgatcctaaaaaggcaactagcctaaactggccactttttcgtcaattaaccgaatgacttctttacgcgcatccgcatcggcgacaaaatcaagctgatccccgtcgatctgcatcttcgggctatgatcgtaattagcgtaccagtcgtcataacgttcattcaaagtctgataatatttatataaatcaggatcttgatcgatttgttcgtaagaacggccccgcttttggattcgtttcaacatcgtctcaaaagaaatgttgatatgaataagtaaatcaggactcttttgatgagatgcttctggcaattcctgcatcatattgtccaataatgaatcataaatgtcaacttcggtagaggttgctcggccaagatcaccattcaaatggaacaatagtgaatcttcaaaaatcgaccggtctaagacgtccagatcgttagcaaaagctgatttaatactatccaaccgtttatttaaaaagtagatttgtaataagaaggcgtacttcttaggatccttataaaataacggcaaaatgggattatcatcaactgactcgtaaaacgctttagaaccaaagtggttagccactaactgcgttaaactcgtcttgccggcaccgattgttcctgacattacaagcatggggcgtctctccttttaatcacgtcaaaattttgatttctctaaaagcaacactacatattgtacgcacccacgtcttaaaatgcaatatctggtgagtcaattcagtaaaaaacttcgtggcccatgtcagaaattcgcaataaatcagtccttcgaacagccgcccaaaaccgacacacatcaatctacgcttttgaaactcacccgaaatacgccgtgccccaatgaggacttgttgtgatgcgcctatgcccctagcgaggaaagtcagcgaaattaaaagcgcccgttagtgacttcctaactggcgccataattacacttgatttagtcttccagagcgtgccagatcaggctacttggccgccttttcgcgggcctgcaacaaactgacgtattgttcgagggtcagattgtgcttggtcataaattccgcactcgccttaccaacataacggaaatgccaagattcataatcgatcccggtcgattgcttaccgtccttagtaaaccgcaacacaaatccatagtctgccgcgtgattgatcagccactgctggcccttgttcttatcagacgatgacagcagctggttaccgtgcgtactgtaccagtgcgtattcatgatatccgctgcgagcccagtttcgtgctcactaccgctagggaccgcaacatattctttggtcagctttaaggcttccttggcggatttcccttggttctcataggtttgaatcgactgatcccaaacctctttttgataagcgactgaacgatacccagacacgattgttgctggatagccggctttttttgcccccgctagaaaggcttccaatggtttgacgatagaactacgggcttcaataccatccacgctcgacttattaaatgtcatctcagcgcgcttatgccacttattgacgaccactaagtcgctatcggtcgatttaacgcctttcggtaaggcactaatcagtcgttgccgcttggtctgcgtcttcgtcgacttagcactcgtagaactactagtcgctttagacgtcgactggctagcaccacagccagccaggacacctgctaatgacactaatgctagacctcttaacaaatttctctttaacatctctctcgctgcctttctcatttcagcttagcataatcatgcccgactcgcgtacgcttaaggataagtttgctaatttttaatgatttcatctattcattctatcaaattaccatagttaatcgacgcgcacaccccccaattttggtttaattatattcaggattccggtccttctcaagcactgctccgcgatcaattgcggcaggcttggcaaccccaatcaacacactaaaaacacgaccgcacttggctgtgatccactcgactagtgccatcaaaaaatgcgattgacttaacgtcaaccgcattaattcaaattagcacttaatcttggtgatgttttttgcgtgttaaatcgaccttatctaacggaatcatcttggtgtggtgtcgaatcttataataaacatacaagatgatgaatagcggaatgctcatgtaagtcactccaatggcctgccaatcaagtgttgcaaatgaatgcaagtcttgaccgataatgaccacgacacacaagataaaggcgaaccaagggccaaatgggaaccacttagcatggtaccgtaattcactcaattgatgaccctgcttaacgaaagcgcgccggaaacgcaggtgtgagattgcaattcctaaccaagcgataaagcccgttaatccactggccgatacgaggaagatgtaaatccgttccccgaatagactcgataagaacgtgagtaatccaatcaccgtcgttcctaataatgccatgattggaatcccacgacgatcgacccgaccgaacgtcttcggtgcgtagccttgtaatgacagggaatacagcattcgtgtcgaagcgtacatccccgaattagcggcggatagtacggacgtcaagataacggcgttcatcacactagccgcggccgccaacccggcccgcttgaagactaacgtgaacggactgatggcaatatcgcttgccgatgaccctaagagatccttcgacgtataaggaatgattgccgcaatcacgaaaatggctagaatgtaaaataacaaaatacgccagaaaacttgtttaattgccgctggaatacttttctccggtgttgctgactcgcccgccgtgatcccgattaattcagttccttgaaacgaaaaaccagcgaccacgaaaacgctcaagatagttggaatcccaccaacaaacggcgcctttttataggtgaagttactgagaccagtggcatgaccgcccatgattcccacgatcgtcagcacaccgatgaccaagaatacgagtacggtcaccactttaataagtgacagccagtactcagtttcgccaaacgaccggactgacagcgcgttgatcgtaaaaatcaaaacgagcgcaatcagactaaagacccaacctggtacggatggcagccagaactgcatgacaatcgctgccgtactaatatcgaccgctaacgtgattgcccagttgaaccagtaattccagcccatcgcaaatccgagcgccgggtcaacgaacttagtggcatacgtggaaaacgagcctgagacgggcaaataagttgccatctcgcctagactagtcattaaaaagtaaaccataatcccaatacccacgtaggctaacaacgcacccccgggcccagccgtcgaaattgccgaaccggatgcgacaaacaatccggtcccgatactaccacctagtgcaatcatggataagtgccgcgtctgtagtgaccgatgcacttcctgatgttctttttctgccattgcagaacctccaaaaatcgatttatatctaaaagtgttcacaccgattcaggtaagcacaaccaatataaaaagcctctctgcctcacgataacgtgcgcaaaaagactttaatcagattgattgacataattgctgatttcatcgtcgatagcgccccgcagctattctagctgcgacagtccttgatttattcaaccaaggcccaacggatgaatcggtcactgattcatcgatttcggcggttgccccgttcactgaccttcataagtggtgacccacttccagtcggctactattgttaaccgcgtcctcttctttcgatatactcaactattatatccgaccgaccatcttttgacaaccggtcaataatgttaattttaataaaattggtctggtaacatcgttttgcctaacgccttgttatcagaataatctattggaatatctacgacaacggggccatccgtagcaaaggcctgatcaagtaccttttccaagtcggcaggttggtcgacccgcaagccagtggcgccgaagctttcggcatacttcacaaaatcaaccggaccgaagtggaccgccgcatcctcgccatacttcatttcttcctggaacttaaccatgtcgtaggtgccgtcattccagatcaagtgaacgatattttgcttcaaccgcacggccgtttctaactcttgcgcggaaaacaggaagccaccatcaccagagaccgacacgatttgcgtgtccggccgaaccaaagcggctgcgattgcccatggtaaggctaccccgagcgtttgcatcccgttactgaacagcaagtgccgcggttcatagctccgaaaatgacgggccatccagatatagtgactgccgacatcgaccgtcaccgtcatgtcatcactgacccgttgttgcaaggccgcaatcactgacagcggatgattcaacttggactgcttatcaatgttaggtacgaaatcacgggtctgaagccgttcttgtaattcgcctaagtaggtccgggcgctatcactaatgtcatagcccttcatgtatggcaacaagaagtccaacgtctgggcaatgtcaccgatcaattcggtttccggttggaaattatgatcaatttcagcgcgcattgcatcgataaccacgatacgggatttgccttccgcattccagttgcggggttcatattcgattggatcataaccgaccgcaatcactaagtccgactttttcagtagcatatcccctggttggttgcggaataatccgacccggccgaagaaatggttcgcttccaaatcacgtgagatcaccccagctgcttggaaagtctcgactactggtaaattagccgcggataccaagttccgaatggctttcgtcacttcaggtgaggaggcccgcatcccaacaagcaagactggcaacttagctgctttgatcttttgtgctaataacgtggcttcaactgggctagctggtccaagctttggcgcttgaatcggcgtaatcacgggtgtccgcacgattgaatcagtcacatcttgtggcacactgacaaaactagcaccttgcttggcagccgtcgcttcttgataagcgttcgcaagcacttctgaaatattttctggctcttgaacttccgcactatacttcgtaatcggcttaaatagggccgcgttattcatactttggtgggtcaatcgcaacaagtcagcacgctgaacttgacctgaaatggctaagaccgggtcgccttcagcggttgccgtgacgagcccggtagccaaattactagcaccagggccagatgtcgtcatcacgacaccgggtttcccagtgatccgaccaattccggcagcgataaacgcagcattctgttcatgccgcgtcacgatcagccgtgggctctttgggttgactgggtgttctaatcgttcaaagacccggtcaatcttagcgcctggaatcccgaaaacgtacttaacatcgtgatttacaaggctatcaacaattgcatcagccccgtagtatttcttatctgccatgttattcccctctatcttgtgaaattcattgttagaataccataaaaaaagccttaataacagcattttcagccttgtgaaataaagtgtatcattttgaaaatgatccccgattagaaaaagcgcgtcaatattgatttaccgagcgaaaccgctctcaattttcattaagtttgtacgtcgtctcacttatgcaatcgcattcgactcagcaacacatttaactggcccattttatcatccgaataattcgtccaatccagcaccggaatccgattaacaactaacaattccttgatcaacgtcgccagtttttgctggtccaaaaaatctaaccatagttgatccgcacgcgagaatatcccgttgacgaccttcgtcccttcgtgcgcaactggttcaacatccttgaatacttggtcaaaataaccatagttcggaaaagtctgcaaggttccttcgatggctgcgacgacatccgtgattgaaatatcctccggtgaacgtgccaagtgaacaccaccgttattcccactggtagacgtaaccagccccgccaccactaatttgcgaataatcttacgaatgtacgaggcggaaccgccaattcgctcgtgcaaaacatccgccgtcaacggcacatcaggcgttcgtcaacctgcaggctttgcattgtttgtcctgattaaaagctacttagttgttaatttgctaactttggtgagtgctgggattaagcccaagctatctaacgtttggtttggtaaaacaacggtgttggcattgccgtccgctaaggctttgacagcttccgtgttttggaagataaagtagttttcggatgattgtgccaaggcttcgtttaagatccgcgtccggtaagcatcagcatctgcttcagtttgaacggctgttgctttcgcctttgcactattcactaaagcttcgttttgggctttattggtggctaataaggcccggttattggcttcattttccagtgtgattgacttactcttaccttcagcagttgcgatggtggcatcccgttcccgcgtagcttgcaggagtttattcatggaagcctgaatatctgccgaagggttaacggaatcaatattgacccggtcaacgtttaaaccgtagcccgccgtaacggaggagatctccttgaagagggcggcattgatttcttgcgtcccattcaggacttcgtttaattctttgttcccaatgataccacgcagtgccgcgcgggtatcttgaatcatactacgaacggagtcttcgtttttaaaaacgaagtcttcaatattagtgacgtggtacttaagcgaaatcttaactgagatttcagcgttatctttggtgataacgacttgttggttaagatcaacgggtgtctgagccgtgttaacggtgatgactcgtgagatgaacggtttaataaagtgaaagccggaactaatgacgcgctcgaactttccaaatgttaagacgacaccttggttcggttgggtgatgatgcggatggaagcgattaggactaaaacgaccagtagaatgacaataattgcaacgatgatgcctaccataataatttccccctattgttgtggtgcgataatcgttaccgttagaccatgagcactgacggccgtgatttcaacggtatcgccggtgtgcagtggtgttgcggcgtgcaaatggtacaagatgccatagaatgcgacgccgtcagttagatcggtcggtttgataatgaagcgctgaccgattaagcgctgatctaagtatccctcttgcatagatgacccacctttaatgtgataatgattaaattatatgctgtttttggttagattgatagggccgttataaaatagtgggtgagttttggattgttgataaagtatggcgataaatggtgaattcatgctgcatatcgcccagtaactatttggataagctcgttttagagggcggttcaagtaatacgggattggtgagttaaaggggcgcttgaagtatttaagccgacaaaaaaaccttcgtacgggaatacgaaggtcaaaaggagtaggtcagcatatgacggggaatcatatgctgataacttgatgagcgtttattcatataagcggggggacgttcacatgccgctcatcaagctgtcaaagttgttacgctttgacggatttcattactttggaggagtaaatgaaaagaatgttaattattatagtagcaatcttggagggggatccttaattgctatagatatatcttaacaacgaattgtgaagaaaatgtgacgatgatttttcaaatttaagaattattgattagattacgaaaagatttatgactattgataaatttatcggcaattaaaattgcgtaagaattatctgtcagcgctttcgcaatggtggctttttaaattagagcgtgtatcattaataatgatcacggaaattaaagacaggagatgcttgcatgtacgaacaagcttgtaccacaattttagttgggaagaaggcgaccgttgatggttcaacgatgattgcccgcaatgatgatacgtttatgccgattacaccgcaaaaatttatcgtccatcccgccgttcatggtcgcaacgaaacgttaacttctgggaagaatggctttaccgcaccacttccagcagatggctaccgttaccaagctgtcccgaacattgaagtcgccgaaaagggtgtttttgaagaaaatggctttaacgaaaaaaacgttggtgtttcttcaactgaaagtgtttatggtaatgaacatacgctgacttttgatcccttcgtgccgaatggtctcgcagaagattcattgccaaccatgctcacgccgttcattgattctgcccgtggtggggttgaatacttgggccagctgatcgctaaatatggttcgccagaaggtaacggtgttttgttcaatgataaagatgatgtgtggtacatggagatcgtcactggtcaccactgggttgcacaacggattccggatgatgcttacgcggtggctgccaaccaagttgcgattcaatgggttgactttgatgatcccgataactttatgtggtctgatggcattcaagaatttgttgtggaacaccatttgaatcctgacaaagaaggctttaacttccgtcatatcttcggtactgataatgaaaaagaccggcactataatactccccgggtctggtatggccaacgttatttcaatccagagatcgaacaggatccgcagtcgagtgagctaccgttcatttgtcacgcagccaagaagatttcagttgccgacgttgaatttgtactgggttctcattataacgaaacgaagtacgatcccttcttgaatacaccagaagctaaaaagtttcggccaatttcaatgaatcggacgcagaattcacacgttatgcaggtgcggaatgacgtaccagcagaacaaagcgcgattatgtggatgacgtttggggtaccagcttttgcgccatacctcccattccatgcgaacgtttctgaaactgatcctagttttgcgaacacaccgctaaaacatgatatgaatagtgcttactggctctaccggacactatcaatgattgttgaatcacactatgctgatttcgttcaggatgatattgattatttgaaagaatgtcgaatcgaactgggccaatttgtggctgcgaccgatgagcaagcggcgaagttatctggtgacgagttaacggcttttttgactgaacaagataaagtgatggtcgcaaagatgcgtgataaagcccaagctttgattggtcaattagtcaccaaaggtttaacgctctcgaaactaacctataatgttgatatcaatctttaaactttcgttatgacggtatcagcgtgtataattaagttattaagaggacaaggagctgatggcaaatggatgaaaatgtcttatttaatcctggtgacgcaatttcagaatcgcatgactacaatgaagcgctccgtagtgcggatatttataatgcgcgtcacggacgtaagcgcggactcatgattgcgcggccgctagaacaggatcacggttattcggttttttacgcggatgacttactgacagccgatacgccaagaccagaagcacgtcaatatcacgttgaaaagcgtattccaaaagaatagttcaatcatcccatgatcagtaaaaagggtcatgggattttttattttctaaacagtaacccatgatattgatattgggttactgttgttttataatagcgtttaaattgattaacaggggtgcgatgatgacgaatcgacagacgattaaacacctgacccagacggcgatggtgaccgctttgattattgtattaggtttctttccgggaattccagtgggctttattcccgtcccgattgtgttgcagaatatgggcatctttttagccgcggagttacttggccgcaaatatgggacgatcgcagttggattgttcttaggattagtggcactgggactacccctattatctggggggcgtgggggtgccgcgatttttctcgggccaacgggtggctatctcgttgcttggttgctggcaccaatgctgattggaacgttgatcaaaataacccgggcgatgacaagtggttattggtggctagaagttggcattgtctggttggctggtatcttatttgttgatgtaatcggcgctagttggctagctgttcagtcacatatgactttgacggccgccttgctgtcgaacggggcctttcttcctggtgacatcattaaaggaactttggccgtatttattgcccggcgtgtgcgggccatcgttgattttggattgccagcttagtaaatagctaatgtgattggcaggtcaggaggtcataatgacaactaaagaacaggttttaacaattttattgcgtcatcatggtgagtggcaatcgggggaccagcttgcccaatcagttggctgtagtcgtgagagcatttggaaggcaatcaatgctttgagaaagcaaggacaccagattgagagtcgtaaaaaccggggttactgttatctgggaagtcgtaatttggatgccaaagccattcaaatctatgggcaacgtcaatttacggggccccttgaagtggtcgctcagacgccgtccactcagattctagctaagagctttttaagtcatcatcagccacagtttgccgccttcttcgcggacgaacagacagctggctatggccgtttgggccgagacttctattcaccggccaaaactgggctgtattttagcttggttgttcctaatcccacgaatgcattggtcaatgtgggtttactgacaactggtgtcgcggtgagtgtcttgaatgttttacagcaattttatcctaataagaactttgggttgaaatgggtcaatgatatttatcttgatcagcataaggtcgggggcattatcacggaagcaagtttggaattagaatcgacttccgcaacggcttttattgtcggtgtggggctcaatttaacgaccaccgattttccgcgagaattgcaagcccgtgcccaagcggtcgacccgagcatgtcagtggatcgcaatcggttagcagcggccttattatcatcactagtagcgctatcaaaacgctacgctacggccgactttttgccagcatatcgggctaaatcattagtgttgggtcaacaagtgacacttcaagtgggcgattccgtggtgaatggggtggctgaagatatcgatgaacatggtggcttagtggtccgcatgttgaccggggagcggcggacatttacgagtggtgaagtgatcagggtagggttaccagtatgactgagtgggtaccagtgatttacggcatcggtttagacgctgccggtcggtgccaacattatcaccttgaaactgatatcgcggcattgtggtgtcggcgatgtcaacactattacgcgtgttaccggtgccatgatacgttgtgccagcatacttttgtggccagcgctccgacggatttagccgtgatgtgtggtgcttgtcgttatcgaatgacggttgatcggtatcatgaggggcaatgcccgcactgtcaccggccatttaacccgcggtgtcggttgcatgacaaggtttactttgaaaagcaaaattgagacgtatttttagtagttttggctgaattcagtggttaatcgaaaaacaattaaaaaattgacatattctaattaaaaactcataattaagcttgaaattatggttgattgtgaatttgtgctgacaaccattgacagaagggaagcactaattttgaaatttgaagagtccaaaattttgcagcaattaccaaaacagttttttgcgaatctggtcaaaaaggtcaatgccaaagcggcggccggtgcggatgtgattaatttaggtcaaggcaatcctgaccaacccacccctgagtttgttgttaaagcgatgcagactgcaactgccaatcccgcggatcacaagtattcgttgtttcgaggtttgccgcgcttcaaacaagccgcggctgatttttacgaacgcgagtacggtgtgaaattagacccggagactgagattgcggttttgggtggcagtaagattgggttggtcgagttactctttgccttactaaatccgggcgatacaatgattttacctgaccccggttacccagactatttatctggcattacgttagcacaggtgaagttgtccctgttacggttaacggcggctaaccatttcttaccagattatcagcaggttgatccacaagtggccgcggtggccaagctgttgtacctgaattacccgaataatcccactggtgccgtcgcaacgccgcagttttttcaagacacggtggattttgcaaatgaacatcagattggtatcgttcatgactttgcttatggtgcaattgggttcgatggtcagcgaccggtaagcttcctacagacaccgggggctaaagacgttggaattgagatgtatacgctatctaagtcctttaacatggcgggttggcgcgttggttttgccgctggtaatgctgacatgattgaagccttaaatttgattcaggatcatctgtttgtcagcgtctttccggccattcaagatgcagcgattgcagccttgaacagtgaccaacagacggtccacgaactggttgggctgtatgaacgacgccgtaatcagttctttacggcagcccgcaagattggatgggagccctacccatcaggaggctcattttacgcttggatgccagtccctgaagggtataccagtgaagcatttgccgatttgctgttggataaagcggcggttgcggtggcaccaggcaatggttttggcgcgggtggcgaaggctatgtgcgcgttggcctcttgattgatgaaccccgcttcacggaagcctgtcagcgaattgcaaaactgcacttattcgatcgttaggatggcctcttagcattaatgatgacagtcagtcacttgcttagcataattcatgcaacgggggcgcaactcgttcttgattgctcggaaatattgagctgtaataacggtatcaaaataacgcaactggcatgtgaatgccagttgcgttattttgattcgaggtattgaattattataaattaccggtgctctttaaccgcttctctaacaggtacgcgtccatgtacccaaaggataattcaacgacctgatcgagttcgatcatcgtgccaacatgattaatttgattatcatcatccacgttatagaagatgaagtgcccgttcgttaacgttcccggatagccagtcattgctggcaacatggggttttctgtcgtgatgtgaacgaggttattgaaagttgcggcttgtcgcaaaattgaatcaaaaagatcagttgtggcgtcaaataaccgttcgtcgtttaagacgggttgaacatttaactcatactggcgatttaattcaataaagccacgcatcgtctgtaaatagtcggactgggttgtcaccgattcaattagtgaacggcgacaaagggtgtagcccccaaattggcccgtcatatcgatcagattgagcaggacactatcagcgttcaatgcgttaatgaagccaacaaagaacatgtcagacccgtccgctgaccgaattgcaatcagttggtgctcatttaaggcgttgtttagagtatgatcaacgtcgtcaaactcgctgactttgacggtggcttcatgcgtgtggatggtcttgacaaaggcgctttccaataagagttcattgccgcaaaactctaatatctgaattgcagccaatgggatttcctgttgcccgttgtttttaaagttaaatttgtcaaaagttttaaaggtaatcgtttggtcagtgacttgttggacctgaccttctaaataattttcgttgtcttcgaggactagtagcacaacttgatgatcagtttggacttgggtgactaactgtgttaggactggccgttgatcgtctaaggctacggttggttgtggcacactgttcaaaccttcagtagttgcattttcaaggcgaaaggccatgttatcaaggtcttcactcatcatttcaacttcatcaatgacgtcgtagcgcatgaagacggcgccgtcctggagcccagcatcatcgtaagtattcacgacaacgccatcaggtgccagacggtcgatgtagccggtgtaaaccacttcgctattggcttgatataggttgatgaggtgaacctgttgtgcggctaattgtaaactctcaataattgaactcatcgtgtctaacccccttagttaatgttccctcatcatagcactttttgaggtgaagacgccattataagtcattattcggctggtttggtaagtgtgttatgactaagtgagtaaacggatgtccccgtgctattcaggtcgatcatgtcattagaaggggccttgttctgacgatttaaaacagattgaacttacatctggacgcggtcaccggcattgagtgcggctgtttggtatgtgtgtaacacaacgtgggctacgtgaaaaatagttttccgatgatgcgttcgtggctagtgattttaatgtgcgattcggtatccaaatgatgattgccaaaaacaaacgcatatgggcaatttaaaacgccaagattgtaagagctttctttacttagggataggagtatcggtcaataagtatctattgataataggtaaatatttaataaaaaatgttattttcggtgctattaacgaggtttatcgttataatgtagtctgcggtttatcttgaccgtaaatctgtcatgacctttcaagaggcgcttgatcgtgttgcgacatacatttaaggagtgcactatgtttacgatgtttaagacgattggcgatcagttcgccaatttcaagattattcggcgaatggcgaagtatgatgatcgggccacataccaaagccattaccttgggttagcgtgggaatttctaaacccactgattcaaatcggaatttattacttagtattcggggtcgcgttaaaacgtggcgatccgatgccaggaatcccgtatttaccatggatggttgtcgggattgcaccatggttatatatgaacaaaacgacgctggacgcgtcttctagcatttatcgtcaggttgggttagtttcaaagatgaaattcccagtcaacgtattaccgtcaattaaaatttatggtaacttatatagtttctggacgatgattgcttttggaatcttcctgatgttcgttaatggcatttggccctcagtttcttggattcaatttatctactactttggttgtatgatcgtattaatgtattcacttgggatttttaatgccacggtcagtgttctgattcgtgactggcatatcacgcttcaatccgtattacggatgctgttctatatgagtggggtgctatttaactttacaacgtctaacttccccgcagtttttgtgcgcctactagaactaaatccgttctactacgtgctcaacggaatgcgggaatcgctgcttaatcgtggttggatctggcaacagcctaatatcacgttgacgattgtcttttggctcttcaatctcgttgtgattctgactggaacgtatctctataacaagttccgttcgaactttgtggatttgatttaggaggcggaactgatggaaaatcaatataaggttgaattgcataatgtcactaaagaatatgatttatatcgtagtaacaacgataagttaaaacacttttttaacattggtaatgttgatgtcccgcggttttggtcgctaaaaggggtcagcttaaacgttaaaccaggtgaagcgttgggtattatcggaatcaacggttctggtaagtcaacgatttcgaatatcatttcgggaatcattcctcaaacgactgggacagtggatgtgcacggtgatacgtccattatttcaatcggagccggtttaaagtggaatctgaccggtgatgaaaacattcggttgaaaggactcatgcaagggttgagtattaaagagatccaagcggttcgtgatgatattgttgatttcgcggatattggtgattttattggtcaaccagttaaggactattcgaccgggatgcggtcacgattgggatttgcgattgcggtgcatatcaatcccgacatcatgattattgatgaagcactctcggttggtgatgacaccttctatcaaaaatgtgtggataagattatggaattcaagaagcaagggaagaccattatctttgtcagccataatttacggcaagtggaattactttgtgaccgggtcgcttggatgcactttggggatcttttagaagtcggcgagaccaaggaaactgttgatcattaccggaaattctctaaggatttcaaagcgcaaacggcggcttatcgtaagaagtatcaggtcggtaagaagaaggaacaagcggactttgacattgtcgcttatgaacgacaattagtcgaagaaaaggctaaggatagcgataagagtaagcaggcagttagccgtcaagttcatcggacgctatacaagcaaatcttgccagaaaagatgacgattgccaccaagctcgtcatgttagtggcaattgtcctgttcgtcttctttgcgttagtgaatgtttcaggtcactcggttacttcggcgattgagaatccgacagtactgttacatccagtcaatcattatattaaaagtcagtcagtcttattcaatagtaagtgacggcggctggttagtggttgcgttaaattaacattaatatcgatgggtgattgcgatggcaatcacccattttttgtgtgcattcaagacggttttggttggaataaagtacaatacaacgtcgcacattattcggactgagggccgctgatgcttttattcgaggggacgagcttgggctgaccgtactaccgatttgaaaggaaaatgtctaaacttcaatgcacaatttatgagttggtttcgggttaaattaagcttgattttttgtaatgcttcagcaatctagttatattatttataagcattagattattttccgcctggaatatcatttggtgggttatcttaatactagagcataaagggggtcatatcatggatacgccactattcttaaatgttatcgcctatgtgctattaatattggtattataatatatcaaattcaaatttccagacagtacctttatccgtttctttcaaaaatacgggtggtggttaattgggctatgttttgtcgcaatattggtgattttggccggaccgcaatttcagaacccctttaacgcgttagatgtaccggctattggggtcatgttagtattcgggtacttctttattaaggataaaaaatcgaaacataagtgatgattaaatgagatagcacctcgaacgatgatgtcgtcctgagaggtgctatttttttgcccaaaaatcgatttgagaagtactggtgtttagccgttttaatctagcattaaacgtgaactgggttattcgataacggaggggcataattaaaaaatcagtttggctccttgagatatatctaaaagatatatatacttaacaacgcgaaagattggtgaatttaatgtatgaattgtttattttaggacagttgatggatcatccgatgacgggctaccagttgcgtaaagcgctggtaaacgtagtcggttcagaattaaccattagttttggcgcgttgtacccgttgctagataagttagccgcggctgaagaattaacactggcgtttaagcggaccactaataaacggccacaaaagttagccacgataacagcggctggtcgcacgcaattttggcagttagttatgacgccagtcgcgctcaacaagcaaacgcagttaacgtttcaaataaagctgaattttttacatttattaagtcgtgatcagcagcaagtaatcttgttggattttcagcaatttgcacggggacaggtcgcacgcttaacggcgcagcacaaacgggtgatgacgaatacccacatgcttgccgctgatattcaagatgcgttgatggtcaatgagttacaacgggtacgagcccaagcacaattagactggcttgaacgccagttgcacaatggaggggaagttaagggatgaaaacaatgtcgtttgtgactgatccacaaattcaaaagcatcgctggtggatactggttgcggtatgtttatttacgttcatgtcaacgttagatgggagtattgtgaacattgccttgccagtcatgagtaaggatttagcgattccaatgaatcaggcagaatgggtcgtcttaatttatttgattgtgatttgtgcgttattgttattatttggtaaattaggtgatatttacggtaagattcgggtgtttaaaatcgggtccttactattcattattggctcgttattgtcaggattcagtgtggggttgccatttctactcattgcacgcagtattcaagcagtcggagcggcaatgacgatgagtacgaacaacgggattattaccgaagttttcccgtttaaggaacggggccgggcgctaggtatgattggctcattcgttgcattggggagtattgctggccccggtatcggtggtttgatcctagctcatttgagctggggctatattttctggatcaacgttccggtgggaatcttggcgatgattttaggtgcaatgattttgccaaaagacgttacgacgacgcaacaaccattggataagaccggggcggggctatttgccgtactcatggttgcactatttgcaggggtgtttatcgggcaacagattgggttcttgcagccggttatcttagccttgtttgcagtggcaattgtgacgctgattatttttgttcgcgtcgagttgcgccatgaaaatccgctgctagcgctacaattatttaagaatgcccgttttagcattagtatcttatgtgcgttattaatttttattgcgaactttttctttaacgtgattgccccgttttatttagaaaatgctcgggggctagcggcaaactatgcgggctacgccttgatggtattccccatcgtacaagtggtggtcgccccgattgctgggacgatttctgacaagatcggaccagaattgttaacgttcgtggggttggtcctgatttcaatcagtcaagtgggttacatggttgtggggctagcaacaccactttggttcttcttattattcgtcggattagttggatttggcaatggtatcttcatggcacctaataattcgatcgtgatgagttcagtggcggtcaaggacttgggcgttgctggcgggattaacgcgttggcacgtgaattaggcatgattgttggaatttcggttgccacgaccgtactatattcggcaatgagtcaatcagcggggtataaggttacgtcatacctgccaactcacccggagatctttattgatggtatgcacattgcgttcatggtctcgttagggatttgtttagttgcgacggtcattactggcgggcggttactaaaacatcgacgcacggcacctgccaagtaaacattagtaaatcaaaaaacgtgttgcgagaaatctgagatgatttcttgcgacacgtttttatattcttgcatccttgatgttgctgaaatggggtcgttaaatcaggcttgttttaaagatccagggcataagctcactgaaaaaaactcggattagcgccgttatgacgccaaactcgtcgtttaattccctagttaggctaatcctcagtcttctcccgtctgatttatgcccgcttgtgatactgagcattgatagaaatgccatgcgactgctttctcgaacgcactgaaacctgtgcatattacgcccatgattccgattatcggaatcgttgttgcttatctagcagttgcgctaactgaccacgaaattcatcgctatggtgttggatgctcgtcaagtcgtgactcatttgaacggtgtagtcagcgacttcgccgtgttcgccttgatcgagtccgagttcttcctcttgttcgtcaacgcgcattctgatgactcgtttcaatagtacgataatgacgatgcaaacgatggtagtaaagccaatggtaaagatcgttgctaatagttgtaatccgaataatttaaagccgccaccatagaaaagaccgtttagagaaattgtgcgattaacggctttgctagcgaataacccagtcatgatactgccgaccatgccggaaacaccgtggcagccaaaggcatcgagtgcatcatcaatacctaagcgtggtttgatgaacgtaatgaagccgtaactagttaatgtggcgataaggccaatccaaaaggcaccagaaatggtgacgtagccacaagcaggtgtaatcgcaacgagaccacaaagggtaccggtgcagacgccgactagggttggtttgcccttggttagcatatcaacgaccatccacgtcatcatggaagtggcggtggcaacggtcgtggttaagaaggcttggatggcgatgtcgttcatggcaagcgccgaaccggcgttgaaaccgtaccagccaatccataaaatagcggtccccagcaatacccataagatgttatagtgctgggtcgcatctttgccatacttgtggcgggcacctaagaatgctgataagactaaagcggtgataccggcattgatgtggacgacggtgccaccagcgaagtcgatgacgccgagtttagctaataaaccgttatcccaaaccatatgaaccattggatagtagatgaggagtgaccagaagatgatgaaggttaataagaatttaaaacggatacggccgaccaccgcgccaacaaatagtgccggcgtgatgatggcgaacatcatttgaaagatgagatataaaccgttgggaatctttgttgcggtaagcgcggtcaagtcgacaccatgcaaccaagtggctctgagattaccgacaaagccacctaaatcaccggaaaaagatagtgaataaccgaatgcaagccataacaagattgctaagccacaaatcatgaagacggataacatggtgttaacgacattccgtttggaaactaagccaccgtagaaaaatgctaatccgggcgtcatgaataataccaatatactagataacactaaaaacgttgaatttgcagcgttcatactcccaacccctatccataccatttgatgttagaaattataacattgattattgagtgacgcactatttttttatattttaggataaataccgaacttatatcggtcaaccaccgatcattatgattgttaatgttatgttttttaacgtgggtctaagctgcagctatcaatcaccattttcaccaggtggtggttgcgatgcagtgtagcgctaatgcacagcgaccggaacagtcggccatgatgtggatgtaaccgacaatcacgactcaacgacctgactagtgattcgtttggaaagcaaaaaaataagtgagcgccccattttgattaattatcttaaactgaaaggccctaatagttgataaaatacgcatttttaattaataaaatgatgatatgaaagataaggcgctttcagcggttgaccattagtaaccggagcagtaaggttatcaccacataaattaaaagatgatgagattattacataacgtcttaataattaaaacggaggttcagcttatgcgaaaatatgcgattattggggtcggtcacgttggagcgaccattgcttatacattagtttgtaaaggaattgcggatgaattagtcttgattgatactaatgcggctaaagctcgcgcagagcaattagatttacaagacgctcaagtccgtttagatagtcgaacgattattaaaatcaatgactatcatgaattagacgacacggatattttatttgttactagcggcaacattcacgcgttagaccatgcttccggtaaccggtgggctgaatttgaatatacgaagcaaatcgttcaagatatcgcgccgaaagttaaagcaaccaaatttaatggcgtggtcatcgatacaatgaatccgtgcgacgcaattacgcactatttccaacgcgcaacgggattatcacgccaacaggtctttgggactgggactttcttggatacggcgcgcatgcaaaaggttgtcgcagaagccttcgactgtgatccaaaaaacattagcgggtatgtttacggtgaacacggcgaatcacaattcagcgcgtggtcaacggttcaggttaatggtattccaattacatccttggttgataagtatcatttggacttagatgcacttgaggcagctgcacgccatggtggctgggcggttcattctggtaagggttataccagttttgccatcgccacttgcgcggttaaattaagtgaagcggtctttgcaaatgctcgcttagcatgcccggtctctgcgtatagtgagacctttgggacgtatgttggtcagccagcaatcattggcaaagatggggtcgagagtgtgacgacgcttgcgctgactgctgatgaacaagctaagttccgtaattcagcggacacgattatcgagaaattccacgcctttgatgacgtcttaagtgactcatcagtaaaaaaacggcaacaagcctaaaaagtgacggttgttaattgtcttgtttggcaaacttctaccaaaatgttaaaattttactaagcagaacgttgactgcattaactatatggtgggatgaatatgcgccgacaattaacaaaccggcaacggtggttagtgatcgtaatcgcgacgattctgggagtaggctgtgccttgcttggtcaatggggccagttcttcggagtcatcgccgcaacgtttgcgctaatgttgttaactagtggctgtttgactttttgtcatcaccgcgggtggcaacctgggagcggcatgttgctagcattggtcacggctacagggtatgtactagttattttaggaagctacggttatttactgcacagctaaacgcagcactttgatacgagaaatcgaccgtatcaaagtgctttttgtctgcaatcatttttagtgtgccaattaagttatgtttcaacaatgattacggccatcgatgctcactaaaaaggccgcgactcatcatcacggccttcctgggtgcggtattgattgtaaacatcaaagtggggtcaccgtacccaaggtattaatggcagacctagttggattgctttacctaaagcctgccaactggtaagcggtaacgcagccgcaccgccgcgctatcggctgcactaataccgttatagcgattatcagctaacatgacactgtggcgatcgcggctgtgttccaaaccaatggtatgtcctaactcgtgttcagccacgtggacttgatctgaataggaatagtggtagcgtacaaaattacgtgttaacaagtacacttgcgcttttgtgtaataaccattggtataaccggtcgaaaaagtaataccggctaagcgataatactgcccactggtggcattactggtccccaaagtaatttgatggtgagcagtggttcccggcacgaatttaaagtgaccagtcgcattccaggcttggatagctgcctggtagacgtgccgctcatacgatgatgcttgaatgacataagtcacttgggcgtgtggccaacggctccgtgaatatggtgtcgcaatcgattttgcgttggcaattggtgtcagcccaagaccaaaaatcacggttaatgtggttaaacctaacttagcactgtacttattcttcattgttgtaaccctctttcccccaaaaacgaaggtcgccatcaataattgtattttaaaacgttgctgagataggggcctcatcctagacccggatttgacccaaaattgcgagatttggtgacgattaaagttagttaaataggttatcacgtgctatgatgagaacatcttatgatgatggaaggaaattgatatgacgattaaacaggcaattgttcaacaagccttgacgttaataaaaccgcaaatggttgttggttttggtggtggctcgacggttggtgaactggtcaaggaggcagccaatcatgtgaatgatattacggtcgtcaccccatcaccgacgacccgccaacttgcgaccgtgctcgggtataccgttgtagatactgcatattgtgaccgcgtcgatattgcttttgacggctgcgatcagttagatcatcacggtaatgcgctcaaaagtggcggtggaattcatgctaatgagaagattattgccagcttggcggatgaatattggttactaacgatgcaggaccggttagtcgatcaatttgatatcaagacgccactagtcttagaagtgctaccagcggccttgtcattagtcatgcggacggtgagtgatcttggcggtcaggcaaccattcgaactgctaataatcgggacggcttcacgttaaccgatagtggcaatttattgatcgattgccattttccaacgtatgccaagctcacggacctgaatgttgaattagcaactttggctggcgttgttgaaacgagctattttgatcacttggtgacgaatgcttggttgggcgatgcggccacgaatacggtcaaagcgctattttaagtgtcatcaggaacgatagcatgaccttaatgattagcaattgagcgctgaaattcgtttgacacttttttaaaataattctaaactgaaggtgacgtataaaagcgccaccattttttgaatctatgttattttaaatatctaaggggatgtcaacatggtaaaaaaagtctatactgattatttttttgatgaacctgcttacaacacacatgacggtggctatattccactagttacaccgaaagtcgatccacaaccgttagcgattccaccgttattgaagccggaccgccagacggatacggatgattactataccgtcacggcacaagaaagcgaaacccagtttttacctggtaagaagactaaaacgtggggctataatgcgggcttcctaggccaaaccatcgtctttcgtaatggtaagcagacccatattgacttgaaaaataaactccctgaattgacgactttccattggcacggcttgaatgtcccagggccgattaccgatggtggctgccacgcaccggtctatcccggtgaaacgaaccacattgactttaaagtacatcaaccagctgcgactacgtggttacatgctcatccgtgcccatcgactgcgacgcaggtttggaaaggcctagcaacgatggtgattattaaggatgacgttgaagatcagttaccgttaccacgtaattatggtgtggatgatattccgttggtattacaagaccgtgaatttcacgatgataaccaatttgattaccgggcggactacgatccagatggtgttcaagggcatacggcgttagttaacgggacggtcaacccatattttgatgtgacgacgcagcgggtgcggctacgaatcttggatgggtcgaaccggcgcgaatggcgtctgcacttcaatgacgatttggaatttgcacaggtcgcttccgatggtggcattttgccggcaccggtttatatgactaaagtgatgatgacctgtgcggaacgggacgaaattgtcgttgatttcggtcagtatcagccgggcgatgaagtcacgctgatgacggatgatacgccgctatgtcgcttccgaatcaagtcgttcgtaccggatgacaccaaactaccagaacatttagttgatattcctgatgaaaccccaacacctgacttacctgttcgcacaatcacgatggatgggatggatgatgaagtcgcgctggatggtaagaaattcgatatgagtcgcatcgacgctcggcagaaagttggggatgtcgccatttgggaaatccgcaacaccaacagtactgaaaacggcatggttcatccattccacgttcatgggactcaatttagagttttggcacggaacgatggcccagtttatcctaatgaacatgggctgaaagatacggtcggtgtcaaccctggtgaaacggtgcggatcaaggtcaaatttgagctgacgggggtttacatgtatcactgccatatcatcgaacatgaagatggtggtatgatggcccaaattgaatcatatgatccacaacacccacaaacttatcatttaatggatatggacaccttacggaatgcttttgcgaaggaacaaggcatcaagcccgaagatgtttggatgcctggtatgtaagtgtagattaagctaatttagtgatgagatgtgaataaagcccggttgcaactagcaagttatctgcttggtcgtagccgggctttatcatttaaaagcacctcggggtcaaaacggtggcggttttgaccccggatttaccatgttttaatcatgatttgtgacgaattagctcgtataaagacaagtaagtctgtatttctacagtttaggcgcagtaactggtacaattcaagtaaggaccgaaaaaaggaggggattaggatgcacgttgcagcaatgattatggcgatcttggttgccgttgaacatttatttattttgtggctggaaatgtttaatgcggatagtgaaatggccgcaaaagcgtttggaattccacggcaaacgctacagtcgccgtcagtgcaattattgtttaaaaatcaagggttatataacggtttcttggccgtcggtattttatacagcttgtttgtgattccggccgtcgcgagcgtcggggcaaccctgtttttcttagcctgtgtgatggttgccgcggtttatggtagtattactgtcagtcgcgcaatcgtcgtgattcaggggctaccggcattaattgcgtttattctgatgtattttgcttaaccggttctttgaagtaatgccattatattagtgttaataaaaaacgttgctacgtgattctgtagcaacgtttttggttgtctaagctatccatattatatggcagattggattacactttgccaatgaccgtcgttttagcagttgctagcacgtgaccggcaatggcatcatgaaattcgttgagccagtatccaggttggaggtctaactcagtatcaagtgcaaatagtttaaatgaataacgatgatccttgtcaggcggatacgggccgacgtagtgttggctaactttcggatcagtctcgtgaacataggcgcccgctgtggaattattaccttggaccatcggaatagcaccggtctgactggcattttcagggatgtgggtcgtggttgccggtaaattggcggcaatccaatgaatccaggtgaagccacctaccggaattgcatcgtggtcaacgaaagtgaacgccagtgaatgggtgccagctggcacatcactaatgtcaacgggaaacgagatgatggggtggcccttatacgtttgggcaacggccgcttgtttggaataggtggctgcaagggcgccattgatggtcggaattgatagttgcattgcaaatccctcctcgtgtaattagtcttattataacgctaatagtcgctggcgtagtgctgggtcaaccgcataaatataaagcccataacgaccacgtttcatcaagacgttgattgagttaaagataatctgctgtttaaggggacgcagatcgcctaagtctgtccggtttttgaacgcttcttgatcttcatagcgttcagggcgaacgacaatccgatcatggtcttcatcatagcccacagaagggccaagaatgacccccgcataattcaaatcaaacccttgaatggtataaatagaaccaacttcattcagtgtctcaggtcgtaaggcccaaggatcatcagttaagttgactttatcccacggaagcttcaattgtccggccgtcacgtaccaagtgccatgattaacgacgtacgggaagtcagcggttgccaccatccgagcgagtccatactgctggtcgcgttgtttgatcaggtcgtataagggttgcccgtcatcaaaaaagcgtagatcaaagttatcgctaacgggttttggttgtaattgcccgcgggtaaaaccatcgatccagtcgacaacatcggcgccgccagtgacccgaaattgctcgtctaagttgtagctcgcgtgcgggtactggtctaaaaatggcttgagatcgttgctgtgccagtagctctttaacttcaagacttgacgggtgtcgaagacgaggacaacgacgcgactatgattgatcagttccgttaactggttgtgacctgtaaagcggttatagcggtctggttgcgtgagtaataggtgcgcttcgtcaataaaaacaacgtctgcttgccggtggtcttttgccaaccggttgatcaacggagtgggtttttgaaagtcttttttgcgcaagacgggatcttcaccagctaagcgcttataaattttgagcatttcattgtgattgacgacgagatagttgtcagtggcctgcaaatcgtttggtgtcaagctacgattgagggcttgtagccgagcaaacgcggcggctaatacggcactcttgccagttcctgcatcaccatgaataacaaagaggctgggccgtttttgctggcgatgggtacggataaaagttaatagttggtgctctaatgattgttgtgccggtgacaacgcagcttgatcatttagcttgaacgttgcggcactgattgtagatgacatattttttcactcccaaatacattatacctgcatattggggctaattgaaatgagagtcattacagttggtggtagaatagaattatgacaaagtgtgggaggaagtaacatgaaacttgatttttcggtggcggtgcatagtatcctgtaccttgatgcacaccgtgatagtaaggtctctagtcgggaactcgcgcagtcactgcatcttaacccggtgatgattcgcaatattttatcagttctacataagcatggatatttaacggggacggttggtaaaaatgggggctaccaattagacttggcgttggccgatatgaacctcggcaatctatatgatttaaccatccccccaacaattagctatgcgcgcttcattacgggaccatccaaaacggatgaacaggctgatcaatccccgattgcggccaatattagtgaaacgttgacggatttatttacagtagctgaccgtcaatatcgggcttactatcatcagtttacgatggctgatttacaagccgacctgaaccaccacggcacgtttttacaacacgaacaagattcagaatcttaagtaaaaagcatcacttgattggaaaacaaggcgattttcgttaataaccttaatttgaaacgggtttgccattcaggattgtcagggctaattatcggtgctatcttagatgtcattatgaaagtggcattgagattgaaaggggccttggcaatgacagcacggttagtgttaattcatgaagttggtcgttatcgagaattatcggaacaacgatactggttagaatccgccgatttttggggtgtcgatgggcgtggcgcgacggtcaatgaggccattggtaactttttgaccaacctcgtgcaatattgccgcgactattaccaacgtggcttgtggcaacttgatgatcggttgttacagctagaccacgttgatacagtgttagcgtacgcgcaggccggtaagtcaccagcaccattatttctgtttaaattagttccggcggatcatgagttggcgtctgcttaatcgaaatattgacgaattcttaaagaagcgttcatacttccaccacactcctgcgctaaactatgcggtataatcaaagcgtaaattaattggagggtgttgtatggaattagataagatttatcagttaatggacaagtttgaacaaagcagtttaactagttttgagtatcgggaccaagattgtgaaattcaaatgggtaagaagggacacggcaagacgacggtgaccccgcagccggcgccacttcccaatcagccggtgattgacccaacaccggtctcaacggttagtaccccagttgttgcggaggcggaaccaaccccagtggcgaccagtacggctagcaatccgacgagcgttgtaacatctgatcctgaaccagaaccagcgccgattgatcctaaagaatgcgtgacggcaccggtcgtcggaatctattacccagcgcattcttcagaagaagcgccatacgttaagttaggcgaccacgttagcgttggtcaacaagtcggcctcattcaagcgatgcagatgatgcggccagtggttgctaagcaagcggggacggtcaaggccttcctagtgaagaatggtgaagaagtcaacttcggtcaaccattgattcaattaatcccagatacaccggatgacatttaatcaggtactgtcagtggttgctgaacgtattaagcactatgtcttgataaaagcgtgacacaaactaaaaatgaaccacttcaagcgcacatgatagttgtgcaagctgaagtggttcattttttagcttaattaatgacgattggtagtggtttatttaggttggtcaatggctgccacggtttctaggaaccatttgttgaaagcagccgcatcaatatcgacacaaacggtcgcgttggttttaccgtcatggtaagcaccacgaatatcgccaacggtctcgccattagcggggccctccgtctggacatcaatccacatcttttcagtcgtgaaggcttctggatgtagtaagtagaagagtgtattgacatcgtgcatcgcaacgccagtctggttgcggtcgttgtaatgaccaaagagggcgtgaagcatttcgccagttttaccgagggccggtaactgttcaatcgattcgcgcgttaagagggccttcatcgtcacgtctaagccgaccatggtaattggaacgccggattggtacatgatttcagccgcatgcgggtcggtaaagacgttgaattctgcagcgctggtcatattacctttgcctaaggccccacccatcgcaacgatttctttaatgtgtggcattacttcggggtaggtcttaaataagagcgcgatgttggtataggctcccgttggcactaacgtaatcggttgttcagcagccatgatgtagtcacggagcgcttcaacggctgtttctggtaatggtttcgcaaggtcagtcgggaagtcataacccggcattcctgaaacaccgtgaattcggacggcatcttcaaacggcttgatcagcggttgggcagccccacccgctacgggaacgtcactgttaaagaagcgcgttagtttgagcgcattcagcgtcgttttgtcgaccgtcacattgccggcgaccgttgtaattaattgtaagtccaagtcaggatgatttaacgcaaaggtaattgcggcggcatcatcaataccagggtcagtgtccatgataatctttgttgacatgttcattcctccaattaaattgacgtgcttgaaattagttctattttagcatactacgggcaatgaattcgattgcaattgtgaagggtttgacgtagcatgacagtaaatacagttaacgatggaggaacggattatgagtcaaccacgggtcatcttaattacgggcgcatcttcggggatcggtaaagcaactgctttgaagttacaagctcaggggaacattgtgtacggagccgcacggcggattgaaaaaatgacggatttagcagcggctggagtgcacgtcttaaaagtcgacgtgacggatgaagcgacgttaatcgcggctgtcaaaacgattcaggtcgagcaggggcgcattgatgtcctaatcaataatgcggggtatggctcatacggttccttggaagacgttccggtcgcagaaggcgagtaccaattcaaggtcaatgtctttggtgtgatgcggttgacacaattagttttaccgttgatgcgggcacaacatcgtggtcgcatcattaatgtttcttcaattggggggaagatctatcagcctttaagtgcttggtatatgggaaccaaacacgcaattgaagggatgagcgattcgttgcggatggaagtcgcaccatttggtatagatgttgtcatcgttgaacctggtggcatcaagactgaatgggctggtattgcggaaaaaaagctgttggcagtttccggtgaaacagcttatcatgaacaagccgttaaggtcggtgcgatgctgtcattgttcgatcagtttgcttccaatccgggagtgattgctaaactgatggttcgcgctgtcaatgatgtgaagcccaagactcgctatcacgcaggtatgggcgcaggggtctcattaacggctcgtcagtggttgagtgatcgtcagtttgaccgcatgatgaactccgccgtcaatggtgcggctaagctgtcaaaagttacgcggcgtaaggaccggcgaaccgggagccggcattatcggcatggcaaaatacccgctgataataattaatctgaataatgatgctaagaagcgagcctaacgatcacagttgttattgtggtaggggttcgcttctttatttcaagtctaaactttaagcttcccccatgtagtatgggagagatagggtctctattttagctggtgcttggatgatgacaagcaggtggattcctgttcgtcagccggtgagcgtccgattccgacctccggagctgggtgacaattgctggaacgtaagccgacatcgatttgagctaacgcacaacccgcgtcatctcaaatacgagtcttattctaagccggaagcaacccacttccgacttagaataatttagctaccgagcacgtttcgtcaatatggcattaaggcgtgaaaggccagtatttaagacgtgggcttcggcttaaatctgtgcccaccacgttccggcaattggcagaaatgcctggaggtcggtgtaggacgcgcaccctaggcaagtttacgctaactcgaacttttccagcgggcctaagctggctgctttggacttagttttgcaccgccattatagcttcgtcatcaccgccgttagcgtagtcgttgcggtggtcatcgcgggatcgtccgcggggtggtaggtgatggtgaggttgggaaattcttcgataatgggaatcagcgtttgccattggggaaggtctggttggtcggcttcgggaacgtcccagttgttttgccgccagcttaaataacgttgttcactaatgattgccgccacttgttcagtggtggtgtgaatatgaacgggtaaatcatgacgtttcaacgtggcgagtgcggcggtcagcgcactcaaggtcagtgaagtctcggtatgtccgtagccaccgtcatttagtgccttttgatggtcagcgtatcgcagaatgacgacccaagcagcgggggtcgttgcggtgatgttggtcgagtggtggtcggtacttgcaaggtaaagatgaatcgtagtcattggtggggcctccttaatcgtaatgataatccattgagtggttcatctagtaatttcgtaaaaactagctagcttcattttaaattaatgaataatttcaacgtgaaactacaatagttacaaaatccagtaaattgccagtgcgtattactattatttttgcgggagtatgctacgattaaatacatggataaacaggaagttattaagcaataaaggtgagcactggaggttagcatgcagacattaatacagacgtttatggatcgacgcggggatttgttgactgcgctatggcaacacttggggatttcattagcatcattagtcatcgcaatggtgattgcgattccgttggccatttgggtcgttcgacgaccacggtgggccgagggattgttacagctcacgagtgtcttacagacgattccgtctttggcactgttagggttattgattccgttagttgggattggaacggtgccagcagtaattgcgctggtgatctacgcgctactgccgatttttcaaaatacttatttgggtatctcagaaatcgatgcctcaattgaagaggccgccgatgcctttgggatgtcacgaatgcgtaagttgtttaaagttgaactacccattgccctaccacagatcattgctgggattcggaccgcgctcgttttaatcattgggacggctactttggccgctttgattggtgctgggggtctcgggacctttatcatgctcggtattgaccgtaatgatacctcgttattattgattggggccatctcatcagcattgttagcaattctgctgagtgcgctcgttcggtggtttcaaacggctaaaccacgccacgccttaatcgtctttgtcggtattttagctttacttggtggtggcggggcttatagtgtctatgccaatcgagttgaaacaattacgattgcaggtaaactcggttccgaaccagaaatcttgattaatatgtataagcagctgattgaagctgaagatgaacacgttcatgtgacgctcaagcctaactttggcaagaccacgttcttattcagcgcgttaaagaataatcaggttgatatttatcctgaatttactggctcggtgctggagaccttagttaagggaaataacccagctggtcaaacagctaaccagacctatcagctcgccaaacagcgcctcgctaaacaggaacaaatgacttacttgaagccgatgcagtataacaatacgtacgcattggcagtgactaagaaatttcaacaagaacatcatttgaagacaatcagcgacttaacgcaagttgaatcgattctgaaacccggaatgaccctagagtttattgatcgtaatgatggcttaaaaggaatcaagaagacttatgggttagacgtgactgccaagtcgatggagccggcgctacgctatgaagccatcagtaaggggaaaatcaacttggtagatgcctatgcgacggatagtgaattacggcagtatcacttggccttattgaaggataacaagcacttcttcccaacgtatcaaggggcaccgttgatgaagacgagctttgccaacaaacatcctaaggtcgttaaagcgttgaataagttagcaggaaagatttcagaaactgatatgcaagaaatgaactatgaagtcaatgttaagaagcagtccgcttcgacggttgctcaccgctatcttgtgaagcacggtttattgaaggagggacgttaaatgacaacggcaattgaatttcaacacgtccagaaagactttaatgggcagaccgtgattcccgaccttaatttaacgattgaccagggcgagttatttgttttggtagggacctctgggagtggcaaaacgacgtcacttaaaatgatcaactgcttagagccactgacggctggtaaaatcctagttaatggtactgatacaaccacgataccagtccgaagtctacggtggcaaatggggtatgtcttacagcaaattgccttgttcccaacgatgacggtggcgcaaaatatcgccgtgattccagaaatgaaagggacagctaagaaggaaattaatcaaacgattgatgagctattggcggaagttggcctcgatccaaaggaataccgtgaccggatgccgtcagaattatccggtggtgagcagcaacgcatcggtatcttacgggcgattgcggcgcaaccagatattgttttgatggatgaaccatttagtgcgttagaccccatctcgcggcaacaattgcaagacttggtcttacggctacacgcccgctatcacaacacgatcgtcttcgtgacgcatgatatgaatgaggcgttgaagttgggtgaccggatcggtgtcatgcaacacggtcagttagtacaagtcgatacgccggctgctctggctcagcatccagtgaacgactttgtgcgaaacttctttggcgcgagccgagctaaaaatgtctatgatgtctacgttgggcgtgtcgggcttattcagggttatctcacagaaaaacccagtgttgcgagtggtcggattcaatcgttagacgttcaagccacgttacgcaccgcctttacggcattgacagatcacgattatgtggcggtcacggaagaaaatcgggttgttggctatttggatcgccaacgaatcgtggcttacttgagtcaacatgaagaagtatcttaatcgtcaattaaggatgaatcagttacactaggttgtgataattgatggtcgctaatgaatttaaggaggaatttcgaatggcggaacagtatgatgttgttgtgattggtggcggaccagccggcaatgccatggctagcggtttaaagtcccagggcaagacagtgttgatcgttgaagcggatctgtggggcggcacttgtcctaaccgcggttgtgaccctaagaaaatcctgttaagcgccgtcgaagcgcgacaagcggcgcaacatttacaagggcagggcctgattggcgcgcccaaaattgattggccagcactgatggcgcataaacgaggctatacggatggcatcaacgatgggacgttgaacggactaacggggcaagatattgcgacgttacatggtcaagcgcactttcaatccgacaatcagttagcggtcggggatcgagtagtcagtgcgactgattacgtgattgctactggtcagcgtccagcgattctaccgattaccgggcacgaatactttaagacgagcactgacttcttagatttggaccagatgcctaaacgcgtgacattcgtaggtggtggctacgtaggctttgaattggcgacgattgcgaatgccgctggcgctgatgtgcacgtgattcatcataatgaccgcccgttaaaagcttttgatgcagatttggttaaggatttgatggccgcaatgacggctgatggaatcacgtttgacttgaatacggatgtccaagcaattactaaaacggcgaccggtctacaattgacagctgataatttcgagctgacaacggatctggtcatcagctcagcgggacggattccgaacgcggaccagttaggcctagccaacgtgggcgttacctttgatcggcatgggattcaagtcaatgatcatttgcagacggccaacccgcacatttatgccattggggatgtcagcgatacaccggtaccgaagttaacgccagttgcaggttttgaagcgcgttatctggtcggtgagttgacgcatcccggcgcagccataaagtatcccgttgtgccaacgcaggtttttgcagcgcccaagttagcgcaagtcgggaccagcgcggccgcggcgactgagcatccagatgagtatcgtgtcaatacacttgatatgacgaagtggttcacttattaccgctttggcgcacaacaagcccaagctaaagtagtggttgctaaagcgagtggacaggttgtgggtgctacccttctaagtgatgttgccgacgagatgattaactacttcacgttgttaattgaaaaacacgtgactttaccagatttacaacggttggtattggcttacccaacgccggctagtgacttacaatacttgtattaatgtgtggttgaattaaatcaaagtccagctattcagcttaactgaatatgtcaacactaacggagtgaccaggagtgaccaggaatgaccggccgctctttttttgtttgaccggaatatcgagaccgaatgacagcgtaacctgttcgtcgtcattttcgtggcaggattgcttcagggtgtaagcactgtgaaaaaaattcaaaatcaaaacccataacgagcccctcagtgttagtaaattaattattttatgaaaccagaagctgccgcttaaacgtgacgatgcttgctatggcagtatcgaactgtgacatagtaaaaactagttttaaagtaaattcaattgtgcaaaatttaatttatgcaaatctattcacaaaatggtcgcgacatggtatgattcaatcatcaattatgatagcgttttcataaaactgttatgactaaggagtgacacaccatgaccgacaagtacattatggcaattgacgaagggacaaccagtacccgcgccattatctttgaccatgcgggccataaagtggccgactcacaacgggaatttccacaatatttcccgcagccgggctgggtcgaacataatgccaatgaaatctggaatgctgtcttgtctactattgcgaatgccttcattgaatcgggaatcaaacccgctcaaattagtggtattggaattacgaatcaacgggaaacaaccatcgtttgggacaagcaaactggcttgccaatctataacgcaatcgtgtggcaatcacggcaaaccgcgccgattgctgagaagctggttaaagatggctatggtgatttgattcatcaacatacgggactcgtcacagacgcttacttctcggcaactaaaattcgctggatcttagaccacgtgaagggggcccaagaacgagctgaaaagggtgaattactctttggaacgatcgatacgtggctcctatggaaacttaccggtggggccacccacgtgacggattattccaatgccagtcggacgatgctcttcaatattcatgatttgaagtgggacgaccagattttgcaattattaaatattccagcggcgatgttgccagaagttcgcactaattctgaagtttatggcaagaccaaggactaccatttctttgggtcggaagttccaattagtgggatggctggtgatcaacaagcggccttgtttggtcaactggcgtttgaaccgggaaccgtgaagaatacttacgggactggggcttttatcgtgatgaacaccggtgaaaaaccccaattatccgataataatctattgaccacgatcggttacggcatcaacggtaaagtgtactacgccttggaagggtcaattttcgttgccggttcagcgattcagtggttgcgtgatggaattcgcctagttgaaagcgctcccgattctgaacgggcggcgcgcgaatcgcataatgaaaatgaagtctatgtggttccggcctttactggtttaggggcaccatattgggactctgaagcacgtggctcagtctttggcttgacgcgtggcacgactcgtgaagattttattaaagcaaccttgcaagcattggcttaccaaacgcgggacgtggttgaaacaatgaagaaagattccggtattgagattccagtattaaaagttgacggtggcgctgcccgtaatgactggttgatgcaatttcaggcggatatcttggatacgcaaattatgcgggctgctaatctggaaacgacagcgcttggtgctgccttcttagccgggcttagcgttggttattggcaggatttggaagaattaaaagcgtcgtataagcccggcacgagttttgaccctgagatggggccagctgaacggacgaacttatacgagggatggcaggcagcggtcaaagcgacccaagtctttaagcacaccccatatcacgcaggaaaatagaggaggacaacaacatggcattttcagcaacgacgcgtcaacaaaatattgaacgcttgcaaaatgaaacgttagatttactcgttatcggtggtgggattaccggtgccggtgtcgccattcaatcaaccgcaatgaacatgaagaccgggttgatcgatatgcaagactttgcagaagggacttcatcacggtcgacgaaactggtccatgggggtattcgttacttaaagacgtttgacgtgggggtagtcgccgataccgttaaagaacgggcggtcgtccaggggattgcgccacacattcctaagcccgacccaatgttattgccgatttatgatgagacgggagcgaccttcgacctcttttctgtcaaagtggcgatggatctgtatgataagctcgccgaagttaaagatcctaaattcaccaattataccctttcgcgcgaggaagtcttacaacgggaaccacagctgaaccctaaacatttagttggtggcggtgtttaccttgattttcggaataatgatgcgcgcctagtgattgaaaacattaagaaggctcacgaaaatggtgggattatggcaagtcatgtgaaggcgaccggcctcttacatgatgatgatggccggatcaatggtatcaccgctgaagacttattgactggtgcatcgttcgagattcatgcccgaatcgtcatcaatacgaccggtccatggtcagacacgattcgtaagatggaccatactgaaaagtatcaatcccagatgcggccaaccaagggtgtacatttagtcgttgacgctgagaaactcccagtgccacaaccaacctattttgattctggtgatcaagatggccggatgatcttcgtggtgccacgtgaaaacaagacgtatttcggaacgactgatacggattatcatggtgatctgaaacacccgaccgttacgcaagaagatgttgactacttgttggaaatcgtcaaccgtcgctttccaactgctaaaatcaccttagatgatattgaggctagttgggccggattgcggccactgattgccgctaacggtagttccgattataacggtggtaattcagggaaaatcagtgataagagcttcaaggaagttatcaaggttgttgatcagtttgaaagtcaggaagctagtcgtgaagatgtcgaaagtgtcctgaatgacttggaaacttccttggcagaggacaaactcagtccgtcagcggtttcacgcggtagttcgttgactagtagtccagacgggctgttgacccttgctggtgggaagattactgattaccgtaaaatggctgcgggtgccatggcgctgattgccaagattttagcagataagtatgatgcccactttaatgaaatcaattcgaagaacctccccgtttctggtggcgatattgatccgcacaacgtggatgcaacgattgcattttatgctaaacaagggacggataatggtttgacgaatgatgaagcgttgcggattgcaaatatgtacggttccaatgctgcgcgggtctttagtctgattggtaaagttgaaccgacgcacggtctgagcttagccgaaacgattagcttacgttatgctttggatgaagaaatgaccctgacgccagtcgactacttgctgcggcgcactaaccacttgttattcatgcgagatacgctggatggcttaaaggatggcgtcatagcgacaatggccgattaccttggttgggatgctgcaacggtcaaagcacaaaccgaattattgaatcagacgattgctgaatcggacttaacagcactgaagcagggctaaggaatggggtggtcatgatgaaagatccattagcactacaattgttgggggaatttctcgggacctttatcttgattctgttaggtgatggggttgtagctggggtaacgctcaataaatccaaagcgcaaaatgcgggctgggttgcgattaccttaggttggggatttgcagtcacgatgggcgtctatgcatccagctttatgagccccgcacatcttaatccagcggtctcactaggaatggcagtggccggtaagttcccatgggcctacgtgattccatatagtgcggctcagattgctggtggggtgattggtggcctcgtggtttggttgcactactacccacactggcaagcaactaaggatgctggcgcgattctcggcatttttgcaaccggtcctggtatccggcggtatttctggaactttatcagtgaagtgattggaacgttcgtcctagtctttggcttgttagccttcacgaaaggccaatttacggcgggattaaacccgattgttgtcggaattctgattatcgctatcgggctgtctctgggtggaacgaccgggtatgcaattaacccagcccgggatttagggccccgcattgcgcacgcggtattgcccatcgccaataaaggaacttctgattgggcctacagttgggtgccaatcgctggaccattggttggtggcgcgttaggcgcactgttgtttaatgtattgccataattttatgactgatttgatataaaccgtgaggactgttggaattgacaacagtcctcacggttttatttgtgagttaaccgagatgtttgactagactttatatatagaatggatttggaaaaacatcctaaactaaacaaacccgctgtattctacgcacacatcacagtagaatacagcgggtttgtttaattaatttaacaagctaggatcaatctggcggtctttaaagtagtactgacggtcgtgatcattaatgtgtcgcaagatatgggcgggattccccacggcgacgacgttatcgggtaagtctttggtcacgatgctaccagcgccaacgacgacattgtcgccaatcgtaataccgggtagtacgatggcacctgcgccgaaccaacagttacggccgatatgaactggcatattgtactgataagcttgttcgcgcaatgatggcaaaatcggatggcccgcggttgcaattgtcacgttggggccgaacatcgtatagtcgccaacgtaaatatgggtatcatctaccagtgttaggttaaaattggcgtaaactcccttgccaaagtggacatggtgcccaccaaagttactgtgaaacggtggttcgatgtaacacttcgggccgatttctgcgaacatcttgctaagtagaatttggcgcttggttagttcgctgggccgagtttggttgaaatcatagagctgatcgagatagccaaattggcgtttttcaagttcagggtcgttaggtaagtagagttcgccagtatgaagacgatcgttattattggtcattaattaaacttcctttcgtggatgatggctgccggtaatcaaggctaagccacctaaaatgagcataatccaaatgagaacgttggcggtgagcgtctgtggcccaagttggccgagactgttccagaccagtggcgcaaagaaagcgctgataatggtggcaatcgtcaggtagctactcaggacgttgacttgaatggtatccaggccagtattgctagtgaagaccaaatatggcccggtgtacgagtaaataaagttgaaaaatacggcagcgccaatagccacagttgcattggatgccaaccataatactaagactgaaatagctgctccggcatagcctaaggttaaggtgaaccggtgtaaatagcggtatagatagccaaaagtgagaccagccagcaagccaccgatgttcatggctgctaaggttaagttgatagtggcggcgttaccaaaatgacgggcgctaaagtaactcggcagctttaattgaacgccccagatgagtagataggtgataaaggtaagtcctagtaacgtccactggtgccgtggtagttgtgtcttttcagtgcgtgcgtgattagtcgttgttgatggaacagtgggttccggtacgaaccacgccacgcccccagcaacaatcaccagtagcccgtatagccaaaagacggcgtgccaactgagactgatcagcaggcctgctaatcctagcaatatcgcgttacctagggctgagaggcccgtctggtaacctaacagtcgggcccgtaaatcaccggtaaagctgtgggtcaacaaactgatggcatgtggtgaaaagaggccgacgcctaatcctaatccgagccgactgaccatgattacggtaaagttagtcgtgatagcgggaatcagtcccatgatggcgctgatcaagagtccactaatcacgattggccgtaatccccaccggcttgttaatcgggggttgagtaacaaagtaatcaatgcgctacagttggcgatggtgacgagccattcaatcagcgtagtcgggacggtgggaaaggtccgtttgagctggggaatgattcctgtaataacggtagtgatgcctgttacagtggaaaggctaagaatactgatggtggtggtcaaccgtggttgcatggcttacgcctccaaccagtttttgatccactgtaagacgccttgttcttggtttgtacctgtcgtggcgttggctacggctgtcacggctggttgagcattcgccatggcaacgccacagccgacttcccggagcatttctaggtcattgcccccatcgccaaatgcagccatgtctgtgaggtcgattccgagaacctgtccgagttgcgctaagccagccgccttattcatgccgggttggataatgtcgatgtcgccgtgaccactgctggttggttcggcgatacccgtcagtaactcgcgtagttgcgtcacaatcgctgtggtgcgttctggtggacatgtgatggcgaacttcataatgtcatcatcaagctggtcgtaactttcaacgacggctaagtgatgataataatgtcgcatttgtgccacgtgctcaggatcagtggtcgttagggtgtaggcacttttggcaccgcaaaccagtagctttaaatccgggatggtttgaatcttattcagaatcgtctggattgtgtctggctgaaaggcgttaagtgcgtaaacgtggtcggcatcgcggatataagccccattttcagcaaggtagatcatctcaggatagtccttgaagaaggacttgagttggaaatattgattgccgcttgcaatcacgaaccgtacgccccgtagttgtaattgttgataaagcagtgcaaattgagcttcgtcgtaagtcatgtcgtcacgcaaaaagctgccatccatatcagttgccattaatttaatcatggttaaaatctcccgtcgtttaattgatagccgtagcttaccacgaaattcagaccacgaagggacatttttagaggcaactagtatcaattcggtgataccgggcataggcttgacgatagtcggtaggcgtcatacccttccaagatttaaaattccgattgaacgtcttactattcggaaagccgcattgcatggcaatatattcaatcttatggtcggtctctaacaggaggcgacgggcgttcatcaatcggatcagtcgtaagtatcggttaacggatagttggacgtttgcattgaattgctgattcaaagtggtcaacgaaacgtgaaattgctcggcaagggtattaccatcgatgggctcagcgtaatgttgattgatggcagtcatgatcgtatccgttaacgtcaagttagggctgaccgttgttgcagtcagaggaacggtaaacgtttgacccagagtgacaagtaactggtaaaagtggctgagaatttgtaatctcagcagatcggtcgtgggggtcgtcaacaggtcgtgaatcgtgactaattgttggcggacatcggcgtaggcttgtgggtgagttttcgatgaggccgcgccgttcaatgtcaattgccagttcgcacttgccggaatttgagtttgtaagaaatcgtcgtcaatgatgatgccgaactctacccagtcaacttcggtgggcccactagcgctgtgaaccacgcgtcgattagtagtccaaaggtcaccaggccgatattcattcgtctgtccatcggtgacgaattttaaggtcgtaccgctgacgagataatttaactcaatcccttggtgccagtgtggggcaacgttgatatcagtcaatggatcatgttcgtaatatttaaaggggaggcggggaattgtctggaccgtctcgtgtaagattttcatcactaaacctcgcttcaagattttgtaaaatcgcaccgcttcctttcaaaaatcaaccttgatggctgacgcgctatgctatattagaattatagttcgcgatgagcggtggcatgacttaattgtaaccgtattcgcagttgaaaggaacgaaaacccatgacaattaaattaattgcgattgatattgatgacacgcttctggattcaaaggggcaattattaccaagtacgattgcggcagttaaggaagcccacgaccaagggattaaggtggtcttgtgtaccggccggccacttgctggggcgcaacattatttagatgcgttaggccttgctggtgatgaccagtacgtgattacgtataacggtgctgtaatcgagagcattgctggccggatcgtcgccaaacatttagtggataatgcgcactatcggcaattaaccgcgtttggaaaacaacatcacgtgccctttaacgtgctcgatgcggacagtacgatctatacagctgaccgcgatgttaactgggtcacagttgtacaggcgtgggaaaacaaagctgggctgttgattcgagaccctgacgatttaccagctgattttcaaattgctaagggggtctttgtaggtgaaggcccgcaactcgatgccgtagaagcgcaagttaagacgacttttggtcgggacctgtacgtggtacgtgcggcaactaacttcttggaactgatgcatactggtgtcaacaaggggcaggcagttcaggatttagcggcagctctggaaatacaaccggacgaagtgatggcactgggagacgaacagaatgatctgccaatgtttgctttcgccggaacagctgtcgcgatgggcaatggcagtgatattgctaaggcacacgctgatcacgtgacggctactaatgatgcgaacggggtcgcagctgcgattcggcagtgggcattatcggattaactcggatgattatttttagcgaaacagttgacaagactacgcaatgagtttatgattgcaaatattaaaaataaatgagactaaacgtgatgatcaggagagtaaagtcagggtaatcttaagcgagccgctggatggtgtgaagcggtggtgagcctggctggaaagtagcctgagaactgctaatgcgacgagctggagtgttagctgggtgcccccattaacgggccaacgtatcgtcagttaacattactgtttggggaaacccgtcatcggtgttggtaattggccgtacgcgcaaaggtgacgagctgcggttcgtgacgaattaaggtggtaccacgcgttagcgtccttacaaaatcaattgatgattttgtaaggacgcttttttagtcccatggcagttgagaggatggagacaatgcgcttaacaagtagtgatggtggtttgtatcgagtgcttttactagtgattgttcaaactggttgatgagaacgacgcttaacggaggagagacgactatgcaaataacgcgaaaattaacaatcaaacattacatcattattggatcaatgctctttgggatgttttttggggctggcaacttgattttcccaattcacttagggcagctggcgggggccaattggttgacagctggttggggattcttgctgacagggacactattgccactgttaggaattatcgccatcagtgtgacgcacagtagtgggatttatgagctagcgcggccaattggcaaacgctacgcgacgatttttatggtactgacttgtgcgactttgggccccttgttcgcgacgccgcggacagccactacgccgtttcaaattggtattgctagtcatgtgagttcggcacaggcaccgtggtatttattagcttactcattgattttcttcagtatcacttactgggcagctcgtaggcccacccggatcgtcgatacgatcggtaaattgttaaacccagcttttctgattttgctcgccttaatttttgggattgccttcagccggccgctagggaccacgaatgcgacaccgaccgcggcctaccaacacggcgcgttcttgaacggctttttgcaagggtataatacgatggatgcgttagccgccttgttgttcggaattgcagttgtcaccacgattcggggccttggtcaacgggatgccggagcgattgctaagacggccgccaagtctagtttgttgagtattagtttagaagcagtcatttatcttggtctgatctggattggtgcgacgtcgttatcgcaatttaagttgtctgcggatggtggcattgcctttggtcagattgccaatgcttttatgggcacgccgggtgcgattgttttagcaattatggcgaccttgacgtgtctgacaacggcagtgggtttggcgacatcgtttgcggaagccttgcacgctaaatttcctaaaatcagttatcgcgcttggaaccgcttggcctgtggggcctcatttctaatcgctaatattgggttggatcaaattattgcatggtcgacgccgatgctgatgttcctgtatccgttggcgattacactgattatcttagcgattgcctcaccgctatttcatcgtgatccgctcgtttatcgatggacgacggcgttaactttgattccagcgttcattgatggtctaggtgctgcaccagccctgattactcggttaggatgggttcaaacgattcttgcatgggatcaacggtacttaccattagctaaactaggatttgattgggcacttcccgccattattggtctactgatcggcttgggctggcactatgcgcgccggttccagaacgcacatgcttacaagatgagccaggactaaaggtgtatgatagatggtaagacttttgatggatgggtgagcacatggattttttgggaatactttgtttgttgattttggcgacaaccctcgctgggcactttgctcaccgtgcggggattcctgccgtgattggtgagattctggtcggggtgatattagggccggcactacttaactgggtccatttaacgactttagttcaaacgttctcagatattggggtcgtggtactgatgttcatcggtggactggaaagcaacttagcacttttacgtaagtatttacgccctgccattatcgtggctattattggagtgatttttccagccgtcattatggggcttgcgagtcgcttctttcagtttagctggtttgaatcactgtttatcggtgtcatcttttcagccacgtcggtttcgatttccgtggaggtactaaagaaatttaaagtgttggatactaaggaaggagccacgattctaggggcagcggtcgctgacgacattatcggggtgattctgttgagtatcatgattgcaatgatgggtggtcagagtggcgttgcccagactaatctcggtatcgtgctcttggaacaggttggcttcttcataggggtcttcatcgtgattaagtgggttgccccgtatctgatgcgcttgagtgatcatctgttgatggctgccagtccaactattatggcgattattatttgtttagcgttggcatggttggcagaactagtgggcttgagtggtgctataggtgctttcttcgccggagtcgcaattgcacaaactgattaccaacacgtggtggacgttagtattgaaccagtgggctacacgacgtttattccattattcttcgtcagtgtgggtttaaatatgacgttcaaaggggtctggcaatcgctaccgttcatcgtggtcatgacggtgctcggtgtgttaactaagttgtggggttgtggactgggcgcgaagttaaatgggttcagtcaccatagtaattacttagtcggtgccggtatgatctcgcgtggtgaaatggcattgataacggcacaaattgggttttcagcgcacttactatcaaacgattactattcggatattattttggtcatcattgtggtgacgatgattgccccgttcgtcttaaagaatgccattcatcgtgccggtcaggtgactgcaacacatagcatcatagaagaacattaaccacatagattgggcggaagttaaggaccgcttggacgccgtagtatgggactacggcgtttttttagtctgatagatttgaacgaggcgtgagggtgttgtattagcatgttgacttattgtcgtggtggttgtcgactaaacggctattttcgtggtatcggtaaattattgtacgataatagctaaaaatatgacgtttgaaaaaatatcgttcgataggtcgggtaggtattatattaagagcatagaaagcaatcaatattgaattgataagcaacaaaagtaaactgattttatcgttaaatatttttaaagaatccgaatttttaaatcaaattgatgaaatataaatataggaaaaggtgattaaaatgaaaaatattaataattttcaggcattgcaaaaaaatgagctttctaaagttaaaggtggtagtaataataagttttggacttgggctggttacacatatgagaattggcgtatttcatcaaggcgagcgtttaatctacgtcagcgcaaaaacactatgactcatcattagaaagaagtggtaaaaatgagaaaaagcatcagtaattttaaagcattaaatgaaaaagaacttggcgctgttaacggtgggatttgcgaggaattaattattcgcggcaatttcttcagttatgcgctggcggaacgttttgatcagccacgctaccaactagttaccgttattgttaacggcgtgttgtttggtctactgcgtggcggttttagttgggtgcagttgtcatactatacggttatgggtctcgtactcgcggcaacctacatattatctggccgggatattcgagtcaacagtgtcgtgcacgtcacagctaatctgagcctcatgctaatggcatgaggccaaatggacttggcaagtaacttgagtgggttgatttaaaagcccgttagtgagcattctagttacggttgtttggatggagtggatgaaatgttacagaagaatttacggtttattggtaatttactaattgtgagtgtgttgagtgtcattattgtcaatatcagttccttacccgtgtatatttatttgattacggccaattggtttacgctgttagttagcttcagtttatatgccgtgattatcgttttcttgtacaacatctataagacgaccgcggaattacggcaatttgattttcgaccgtggcgaacgcggctaaataaacgggccttgctactcatggtgatcggcgcagtcattatcgtggcgcttgcttttggctatgctaagctgacggcggtatggcacataactgaatcgggtaatgaacgtgcattggatttactgttgcggaaaaatccggtagcgatgacactcgataccgtcatttttggaccaatcgctgaggagctgagtttcagggctttttctttagttacgtcttgtcagaccaatatcttgaccgggagtaccaagcggctaccattgttatcaatgggcttcttttcggttatctgcatagcggaaatagcttggtgccattagcatattacacgctgttcggcatagtgctggggaccacctacctattatctaagcatgatattcgtgtgaatagtgtgacacatatgttagcaaatctagggatactctggttggttcctagctaaaataggggtcgtactagccgggtactcagatgaattggatatttgggtgtggtcagctaataataggagcaagagtcggatggattaagatatacacgtgatacgggtataatcaattgtaaaataatataagtgagaaaacgataattgattaagaattttgcagataaggaaactcacaaggtttaccaacaaaaattctctaaacaattgccaccaaccattcagcgattagcattgcgaaaactactaaatgattgatcatgcggaaacaattaatgatttgagcctaccgcctaccaatcacttggaaaaattaagtcatgctcgccaagggcaatatagcatcaggattaataatcagtatcggatatgttttgcaattcgaaatggtaatgagttttatgatgttgaaatagtcgattatcatcatggttaggagaccaaaaaatgaatgaaatcccaacacctaaaattagtgaaattcttgaagaagagtttatggctcccttgcatatctctgcatattttttggctcaacagattggggtacccacgtcacggattcaagacttactacatgatcgtcgacaggtgacggttgatacatcgctgcggctaggacgattctttggagtgtcggatcgttatttcttggaacttcaaaatgatattgaaattcgtaatttgaaacagatacatggtgctgaatatgcacagataaaaaagtatcaagtcagttaaataaggacgtagaccgtagttgcttggtagcgtactacggtttttgcaaatataacctaaactgataagcagcagattttaaattttaaggttatcaacaggtggataaagcggtggcgcttatattatccacctgttgataaccgttgagttggttaattgcactttcactaccgggttaactggtcgtgagaaaaatggtcaagcattagtttcgtgataacgaaaaacgactagaagtagctagcgtaatgacaccgctacttctagtcgttttttaattacagttatactcgtacctgatgttcaatcgtaaataatgtcgggtccaattgggcaattagtggggagacatcaccgatgctgagcaatgtcaagtggtgcattgatcgtgacgaaatcgtatataagatgccaactgaatccgcatcgggataattggtagcggagacatcgtatgcgaccaccgcgtcaaattctaacccctttgcaaggtagattggcataacaatcacgccttgtggcatggtacggtcgctatcggccatcaacgttgttactgtatagcgcttcaggtattggtagacctgcttgctttctgctaaatctttagttagtacggcaacggtgttagttgccttgagctgatgttcaacttcgctacacagactgctgagagcggcgtcttcgccatagcgaatcatgaccttaggtaaatcgcctttacgtgtgaacgcttgaatctggtcgccgtcgggtaatagcgctttagcaaagttcgtaatctgttcggtcgaacggtagctcttattcaacgtaatcaagttcgcccgtcggacattgaaagcatccttgaggcgttccagtaattgctgtggtaactcaatccccttgaataatgcttgttcactgtcacctaacagtgtgaacttagctagtgggaacgcgtgcttgatatataacagttgtgctagcgaatagtcttgcatctcatcgacaaagatatattgcatccgtcggttctgaccactgccagttaggacatcgcgtaataacaatagtggcgcgcagtcaaccagagcaatccgatggtactcaatagcggcctggtaagcggcaattcgttgttgccattggtcaggcgtcacggtggtgggccgatcaacttgcgctaagaaatcgttatattgttcataggtgtctaagaagtaaccattatagatcgcatcgtagacttgccgcagtcgtttggtcacgatttgcttaccaatatagaagacttcatcgtcgagtgattgaaaatcaccacggcgcttggaacctaataagtcgtggtaagcttcgtcgctcaattggtcaatgatatcattgacccagtcagcttgggcttcatcgtcaatgcgatgctttaagcgtttaattaaagtgttcttgattgctaggaaacggtcagctggttgcatcgctgctggtaaggccgccgcaatctttgtaatgacctctttagcgaagaagatttcgccattaaagacgatgttggtgaagcgtaattggtcggctggtagctgatggcaatattgatcgacttggcgcataaagtcggcgctttcttgaaaatcgcgaattgccggtgtcagttgttcacgctggcggtcactttcgtagcgctcaaagaggctttcaacggttagaccttgaaaacgtgcactgagaaattcggcaagcgtgacttgacgcatattgcgctcccctaaactaggtaagacttcggagatgtagtgactgaataagcggttgggcgagaataataccatttggtccgcttctagggaagcccgtgagtggtagagcagaaaagcgatccgttgtaaaatggcggacgtctttccagagccggcgaccccttggacaactagtaagtcactagtggtgtcacgaataatatcgttctgttctttttgaatggttgctacaatattttgcatgtaggcatcattttgttctccaaggacggcctgcaagatttcgtcaccgaccgtttcattcgtgtcgaacatattcttaatctgaccatgattgatctggaattggcgtttcttgatcagctcggtcgtctgttgtccggccggcgtttggtactggacctggcccagagtaccattgtagtagactgaggaaatcggagcgcgccagtcgtaaactaagaaattctgttcagcgtcgacaaatgaggcggtgccaatgtataaacgttcggcttcctcgtcgggactatcttgaatatcaatgcgcccaaaatagggtgagttactgagatctttcaagacaccgacttgccgtttcaagatggcttcggattccacggcgcgttcaaccatttgcttttgttgttgcagttccgcgttcgtttcaatccggtcatcgacttcaaacgtgttgacggaattattatcaccatagtttttctgaatgacatcggtttcgtgatgagcctttgccagcaagtcgtcggtctgttgtgcccgttctttaacttgctcgatgactcgatcaacccgttgttgttcgcgttgttgctcttgatctgatgttgccacgtagagggcctcccgtctgataatcgtctaaatcgcttgaacaattttaggcgggtttagggatgatgtcaatcaaagcgcctgcaaattcactgatttatcagtaattgttgtgaaatgtgattatgagtggcactaaggcgtgctggccaacggtgggcaagttcggcagccttacgatggcaaggctgaaacttgcaacctatgactatttattctaatatgattttaatcattctaataaagtgggtggaacgaatgcgtgtcgcactagcacaacttaatattcagtttggagatccggatgccaactacgagcagattgaagtggccattcaacgggcagctgaacaaactgttgacgtgatcgtcttaccggagatgtggaataccggttatgcgttaactcgcctgaatgtcttggcggatgatgatgggcagcgaacgttacaattactcagcaagttagctcggcagtttcgcgtcaacattgtcggtggctcagtcgcggtcgctcgcgatgggcattactataatgaaatgttagtcgtcgatcgtcagggacagttactgagtcgttacgataaagtccaccggtttgggttaatggcggaagaccgttatattaccgctggtgagaccgagaacgtttttgaactcgacggaactgttgcgatgggggcgatttgttatgacattcgtttcccagaatggcttcgtaaacaagcagcccgtggcccccaagtgatttttgtcagtgctgagtggccgacagtgcggcagatgcaatggcggctattactgcaagcacgtgcgattgaaaatcaaggattcgtggttgcggttaaccgcgttggcagtgatcctgataatcaatttggtggtcagtcactagttattgacccgctcggccaaattgtggctatcggtggtgcccatgcccagttgattacggccgagcttgatttaacacaagttgaccaggttcgtggtcagattccagtgtttgaagaccggcgcccggaattatactgaagcgtaaattggggactggggctgggagcacttaactgaattttaatggtgttgaaggaacgcccgcttgaatttcgatgggcttaaacgtcgaaatgacggtcgttatgttgaaatggtagcggctagctagcgcgaatgatgcccagaatttattttgacacggtcaggtataaccagtacactagaactaattaatcgttgaagaaaagaacagtaaggcgtccaataacagagacctagcgcgtgctgaaagctggggcggactaatgaattggctttttggagattcggtgaacaccggggacccacccttatcggtcaatgagtggcagagacaagctttctgcaatttaggtggtaccacggtgatgcgtcctaattaactagtattagttgatcaggcgcttttttagtgccaatagaaaggatgaatacaatgacaaaaaaagtgattttaacgggtgatcgccccactggtaagctgcatatcgggcactatgtcggttcattacgtaaccgggtcgcattacaagattctggggactatgactcatacattatgattgcggataaccaggcgttgacggataatgcgcatgatcccgaaaagattcgtaaaagtttattacaagttgcgatggactacttggcagtgggaatcgatccccaaaagtcaacgatcttagtccagtctcaaattccagcattaactgacatgatgaatcaatacttgaacttagtgacggtagcgcgcttgaatcgtaacccaaccgtgaagacggaaatcaagcaaaaagcttttggtgaaagtgttcctgccggtttctttgtttatccagtcagtcaggccgctgatattacggctttcaaggcgacgaccgttcccgttggtgacgatcaagaaccaatgctcgaacagacccgtgaaatcgtacggagcttcaataagacttaccaaactgacacgttggtcgaacctgaaggctacttcccaccaaagggcttgggccgaatccctggacttgacggcaatgccaaaatgagtaaatcactaggaaatgcgatttacctttctgacgatgccgatactttgaagaagaaagtcatgtccatgtataccgatcctgatcatattcatattgaagatccgggtagggtcgaaggtaacgtggtcttcacgtaccttgatattttcgatgaagacaaggccaaggtcgcagacttgaaggccgcctaccaacatggtggcttgggtgacgttaagattaaacgctacttgatggacgtgttggacggtgtattgcggccaatccgcgaacggcgtgcaatttacgaagctgatccagctcaagtcttacaaattttgaaggatggtacagcgaaagcgaacgtggtcgctgaccaaacgtggcgtgagatgcaagacgccattggaattaattattttaaataaattatggtagaaaatagtgcaactgatcgtcggatgtgtgaagacggtgagttgcacttttttgtaggcccttaatatatgtggctttccggtaaattaataacgatggcccaacgcatcacggttgctaattaaaaggaaaagacagactaaattgaaaattaggctgatttcgtttgctttcttacatgaatgattgtaaaaaagtgcttgttaaaataagcttttggcaagaaaaggggtggtaaggaattcgaaagcgcttgctgtggctggctttagtcataatataaatttattggtataaaattacgaaaaataaagcgttttcatatattctgtgataatataatttgtgggcacaagttttacaagcacctactaatttatcgaaaggaggtttagtcatgtatcaggcaattgcgcaggcaatcattaaatcgataatggcggatgaatatccgactaagttaccaaccgagaaagtgttaatggcgcagtacaacgccagtcgcaatacgattcgtaaagcgcttgatgtggtcttccggcatgggttgttgcgtcgcgtgcaggggagcggcaattttattatcaaacaaccgcagaacacgaagaaagtgctcaacttatcgattggatttgaccagtccgccatggttgagggtggaccattagtatcaaaagttgtcacgtttgataaagtgacagcggatgaaactttagcacaacaggggaacattgcgcttggtgacgaggtttatcgggtggtgcgattacgttatttgaatgacgtcttgtatgacctggaagagtcttattttccgcgaacggtcgtcccgttcttatcgagtgagagcgtgcagcattcaatcttcgccttcttgcgagaagcatatggtattacggggagcaccacggaaaactacgtccatcaagtgcgggtggacgcgcaacgggcggagttgatcggttgcccagatggtgacaaaacgttgtgcttggaagcaatcaattacttggctaatgggacggtcttcaacttctccaggacgttcttcgtctatccagatttagaactctactaccataccgaaaatattgatttacaaaactagtacgggggtgacgcaacggttgtgttgggtcactaactagcgaaaacctacattaggagtgaggggtatattatgaattcatttatcgaatggcttaacaaacacttagtgccagttgcggccaagattggtgcagttcggtggttgatcgcattacgtgacgcgtttatagcaattatgccggcaatgatggccgggtcgatcgccacggttctgaacgctttagttcgagatattccaacgaagttcggttggatgggcattgttaattcgatgcagtggttgattggaattaatgcgatggtttggacggggacgttagccatcttaggtctgattttctcatttacattcgggtatcaattggcaatccagtacaaagttgaaccagttactggtgggatcgtgacacttggaactttcatcatgagtttgccacaaaactttaccggcacgttgacgagtacgttgagcaagggcgctactaagattttgacggactctggcatggcggttgctggcaaaaaggtgacggcttggggttacttcaacttcaacacgtactttggttcgtatggtttctttacggtcatgattttaggggccattgcgagtgccgtttacattgctttgatgaagaaacacattacaatcaagatgccagattctgtgccaccggcagttgcaaacgccttcactggggttatcccagccgccgctgcattttatgtcgttgggattattaactggatcttcagtaaattcaacaccacggtgattgaatggatcgcgaagattattcaagaaccactattgaatatgagtcaagggtacggcgccgtcctcttaatgacgctgttagttcaagttttctggttcttcgggattcatggttccaatgtcctggcaccaatcttggacggaatctggttgacggctcagcttgctaatgttaacgcttaccaagctggcaaagccttgccatacgtttggacgcggaactgttttgacttatatgcatggattggtggggccggctcgaccttactattattagtagcgattttagtatttagtaaacgagacgaccaacgttcagtggctaagttggcgattggccccggattctttaatattaacgaacccgtgatgttcgggatgccaattgtacttgacccaatctactttattccgttcgttttagcaccagttgtgactgtttcgatcgcctacgctgctttatcagctgggtgggtcgcaccgattacgaacaatatcgtttggtcaatgccaccgattatgaacgccttagttgccacaatggactggcggtcagtggtcttacaattatttaatgccgccgttgcctttgcgatttacgtgccattcgttaaggctgccaacaagattaaaccagcagcgattggagaatagattgtcatgaaaagcttaaagcagtgtttactcatcgggatgaaccttggattattagccgttatcttaagtcccctggccggaacgaccggtcaatgggtgacgctcggattaggtttagcggtcagcgcagcacttttcgtcgtttatcggcgagtgggtcagatagaaaggagccaccagaatgcagattaaattaactttgaacgcccctgtggattatttataccaacagttgatcgattccgcgcgggctgatattcagcagcaaacgggtcggccggcgccacggcagagcttgcaaggttatgagtatgccaaacagtggtccaacggtctgaccggtaatttgaagattacccacgcgcaacccggtgttcgatatgcgtatgaattagaaacgctccgcgatcattacggcgtcgattatcaattcgcaccggacaccgatggtcaccaaactgtcttagaatatgccgaaacctttttaggcaaggataataagacgaatgccaataataagctcggcgtgctattcttaggatggttccgtaaacgccgctttaagaagatgatgaatcagatggctgctagttataatcaataagtaggttgctgaactgaaaaaaggatttcgttatttcgaaatccttttttgtgtccaggcaagatatggaagctaatcagttgcaacgagcgtgacttcgtgtatactcaagatacacgggagggatgcgtaatgaaagcacggttggttggtaattcaacgacattgacaattcctaaaaagttcaatgttgcgaatggcacagagtttgaagcagagcagctagatgatggttcgattttattcaaattgaaacatcgcaatccgttcgagggtgattggtttaatgaccaactagagcagtctgacataaccctggacatggaggacgtcgatagtgaatgggactaatcagtatattccacgtaagggtgacatcgttttaatcaattttaatccgagtgctgggcgcgaaatccaaaagtatcgcccagcattagttgttagtaatcaaaagtatgcgcgattaacaaagctagcgctagtttgtcccattacccatgctgccaataaccggatgacggctttggggttgttgatcaaaatcaaaacaccgaaagtcgacggctatatcaatccactccaatttcacacgtttgattacgtccgtcgggatatgcgtcaggttggcgctgtcgataagcaaatattagatcagacactacaagttattaatgatgttgttaatgctaatgaagtatagcatgttgcttaaaatagcgcttagtcacagtgttaaccaatagtgtgactaggcgtgatgttcgcgacgccaaccaatcgtgacaaagttcgcgtttatctgttggttaagcgatgcttgggagcggacgaacggccagcaaacgtcattcctgcaaagcaggcatatcaatgctaaaattaaaagcattcaatccaaaagttaaactagtgataagggagtatgagaacgtgacagcaacaccattctggtcgcaaattgcggcccaagccaaggcagacgggcgaccattttttacgatggccccgatggaagccgttagtaatactgtttttcggcaagtcattagccatgccgctgctccagatacgttttttagtgaattcgtctatgctaagagtattacgaacccgaatacgaagtttccggtgcatggtcgtttgtacgtggcggcagctgagtcgcaaaaaccggtcgttcaactgtggggtaacgaagcggctgactttgcttcggctacagctgaacttcgtgaccggggctttgaagcagttgatatcaatatgggctgcccggatgggacggtcatcaaaaatcatggtggcagcgatttgattcgcaatccgcagtgggctgaagacgtgattgcggctgcaaagacgtcgggactggccgttagtgcgaagacgcgcttaggttacagtaaagttgctgaatatcatgactggattgcaacgttgttatcgcaacatgtggcagtcttgaccgttcacttgcggaccaaacaggaaatgagtaaggtacccgcacactttgaagttatcgatgacttgattaaaatgcgtgatgcgatggccccggaaacgttactccagattaatggtgacgtggctgattatcaggccggggtggcgttagccaaagcacatcctggattagatggtatcatgattggtcggggagtgttcgcgaatccgtttgcgtttgagtcccagccccaatcgcatgatttgcatgaactattgggtttactgaacatgcagctcgacttgttcgatgactttgccacccgttatgacgtgccacgttttccgtccttaaaacggttctttaaaatctatgcgcgcccagaactaggcgctactgacctgcgtaacacgatgatggatgccaagtcaacggatgatgtacgcaaaattttagcggcttatcaagccaaaatgcgggtggccaatcacagttagtgtcagcagcagacaggttgattaaggcagtaatacgttaataaacttcaatacttattatatagaaacatctcgatatcggcagtgagtgctaatgttgggatgtttttgtatctaaaggggtatgacaattgtattcaaatttaggcccttgttaggagttggtccaacagctgttcaattcgacgttttttttagaaaaaaacttagtcacttttaagtggaacaggcgtcaattgacgtaaataatgactgatggcaatgactagcggagtaattacggacgattgccgtgtctatctgattaatgaggaggtgctcaataacaagtttcggtcacgtgatagtgttaatttttgcctgtagctcagctaatttggatgattgtaacatcatttaaaacgattgtaacattactgcgttacaatcgaagaaaacatgttacaatcatttggatggagggggcgaagaatgtgataaagcttgttaaccaactagaacatattagtcaaagtacgggtatcccggtaactattggcgaatcggtttcaacgtcgacattgtcgttgagtcgttcggatcaaaataatacggtggttgtgcaggggacaatccttgataagccggtcctttttatgtcttatggtggtctgcgcgatttgcggccactagggctctatgcacgagttagtcaggtaaatcgggacccattggtgtttatttttcctcagctttccgccaatgagcgtcacgaatatttgaaaaacagaatgccatttatgacatcagatggtgagatgtttttgccgtttatggggacacggttattacctgaagccgtgaatgactcacctggaatagcgggcaatcctttagcctccgcggcacaacgactagcattaaccatcgtattagcacagttgatttttgaacgtcatccagagaaggccaaagtatgtcccgagttagcagccttcagaacgactgatgaccgtttcttgatcaaaagcggacaatgctttgcatcaacgattggcaagcaagttagcatcaataatcgagttacctttagtcgagcggttaaaccgttagttgcacatggttggctgaagtcaatcggcgagactaaggagcgcgtctatacttgcgagttagatagccgccgtttttttgatcagatagcgccattcttagtgtcgccagttcaatctgttgacttggtgcagttggcgaaagcatcagttgaatcagctagtaagaattttctttattccggccttactggtttatctaaagtgacgatgatcagtgataatcggaagcaacagacagttattatggaccgttctcgacggcaaaccttgaggacaacggttgacgcagataccgatgagcggaaagtcgcttgtgaggtgcaagtttcaaagtatcagctcagcggttttaacacattgtttagactaattgccaattatcctaagaatgtgttggatccctttcatttatacgtactatttagaaatgatatggacgagcggactcaaggcgaagccgaagaattggttgatcaaatttggaacggagcataaggtgatgctatttcacaagttctttgactttttcgaaggctatgaagattgttacgttattattggtggcaatgctgccgcaatttggttagcgcaagatcatcaggattttagagcgacccaggattacgatatggtcgtcatatttgaaaatagtcaactgggcttttcacaaaagtttgatgactttatcgagaaatatggctacttgtgtgctgagatagggggtgatgtgaataagaagaaagtgtattaccggtttgcgttagatcctgcacttgcggtcacgggcgtcccccaacagattgaattgttttcaaagataccattgcgctatgaacttagattaccgacagagacaatgccgttacattttgcaacgggccctagtttgtcggcgattgtattaaatgatgattactatagcttgttgaagcaatgccagcaaaagattggccatgtttctatcttgagcgtacccggattgatctactttaaagccaaagctcatcttgatattcgacaacggttagcaaatggtgataaattacgtcatcgtgctaataagaacaaacattataaggatgtctgccggttgtgtgatttgattattgagaatcaaacgttcgactcaaaggtcgtaccaaggacttgtcagaatgatttaaaaagttttattcagctggttgaagcagagcccgagcaaatattcaaaaaacgatttaaatcagatcccgattttgacttaaaccgggacgaagttgttcgagttctccgatcgttactgccaactagctagtctaatgaacccaaaatgaacggccctagtcaaaacactagcgtcgttcattttgggctttttgatattttttggtgtgcaatccggccctagaagtcacagtgttacatcataaatgttagaataaacctaactaatattttataaacgaaaagtgagcgtggtgttatgagaaacttagcgattgtggatttagggtccaattcggcgcggatggcggtcagtcggttgcatgctaacggcactgctcaagaaatcaagcgtgttaaggaagatacgcgtttgtcggaaggaatgggaacggcacacgtactccagccagccgcaattgagcgaacaatcaaggcgttactcaattttcgccgactttatgaaaaaatgcccaatacggatgttattggcatcaccacagccgcagttcggatggcacaaaatcagactgaatttctcaatcaagtcaagcaagaagtggggctcgatttacgcgttttatctggtgacgatgaggcctattacgattatcttggggttgccaattcattggtcatccatgattgcctaatcttagacacgggtggcgcaagttgtgaactgatcttggtcaaaaatggccgcaaacagcaactgatcagcattccatttggcgcggtgacattatcggaacaattcggtctcgacgacttagtgccgtctgcgagtctatttcgggcgcagatgttcctacgtaaccgactggcagatatttggtggttatcagaggcagtgcactttccaatcattctattgggtggtgccaaccgaaccttagcccgcattaatcggcgccggcaacaaaagttaaaagttgaagacattcacgggtatcgtctgaagacagagacggtgttccatacgtttttggacttactgtcacggtcgaaaaaaggtcgccaggaaatctcaggaatggaatatgatcgtgcggacattattgttggtggaatgttaccgctagtgacgttattacaaatgttggatagtgatcgggtgatcttttctgaaagtggtgttcgtgagggaattatttcagaacacctcaatcaataggtcggttcggtagatgagtcgaatggagagaataggaatgagaatatgacagctgattttcggcacttttatcaaaaaaattgggcggaacgcactgccatcgtagcgcaacaggcccatttaacgccagctgaacaggcgttatttaaacaatattatttaccacaacatcatgaaattattgagaattatttgacggattacccattaccgatggggttggctgtcaacttagtcgtcgatggcgtggatcacattgttccaatggttactgaggaaccttctgttattgcggcagcaagtaatggcgctaaaattgtcaagcgtgcagggggcttcacgaccgtccttaatcaacgtgaaatgattggtcaaatcgttctggagcagttgtctgatccggctgcaaccgctgccgtgattgaagcccacgctgcagcattattaaaagtagctgatgcggcccatcccagtttaaaaaaacgaggtggtggcgctcggcgcctacgtacgcgtattctcggacaaggctatttatcaattgacctattcgttgatgtgcaggctgctatgggggccaatatgctcaatagtatgttggaagccgtggcaaaggccatcggtgtgatgacgaagcaggacgctttaatgagtattctatcgaattatgcaacggcgagcttagtcaaggccgtttgtgacattccagtcggattattacaggctgggcggtatgccggcaaactagttgcccagaagattgcgtcggccagcacggtcgctcagcttgatccgtaccgggccacgactcataataaaggtatcatgaacggtattgatgctgtcgctattgctagtggcaacgactggcgcgccttggagagcggggcacacgcctatgctgttaaggatggtcaatatcgtggcatgagtacctggaccagtgatggtcagatgctgcacggtgaactggaattgccactaccggttggcattgtgggcggttcaatcaagattaacgagttagcccagttgaatcaacgaatattaggtattcaaacggcgggtgatttggaaagaattatggttgccatcgggttagcccaaaatctggccgctttacgcgccttggtcacgactggtatccagcagggccatatgcacctccagttgaaatcgctcgcgatggcagcgggggcgactcctgaggaactccccgttatcttacaacgacttgaattagcatctcaacaagacctcgcaaccacgcaacaactcattgcggaattgcggcaaacaaaggaagagaccgatgactgaaattaaattgaaccaaactgttacagatttattaagtaccgccaattcattatatccgggcaatattagtgttcgttttggtgacacaaaagcgggttacgtccgccatgatcaagcacaacaagtgttagatgatggtgacctgaccgttcaggttagcgatattacggctcctaattacacagcgtcacatgaattattacatctattattgttattacaaggctttccacagattacctttaatttgaccacgcgtgatcaacaactggacgaacaattgatggcaatcgctatggaactttatgacatggtgagccacgtcttggtcgtacgcaaacaacgggaacatgacttaatcgatgagcagatcgaaacgctatacatgcaaggtgtggcggccacaatcgaaccggaacctgcgagcaaggcggatgcgatgatgacgttacggttattaacattgactgacctactcgttttctttaatggtgaattaccagctgatgatttgcaaaaggtgacaacagcctatccacaagcttggccggctgcacagaagctatacgccgtaatcagtcagaagccagttgacaccccgtttgcgatgcggcgtgccgtcgtaaagctgttcaaggcttttgatgatcagatgacggcttggcatttaccagtcctacacggaacggaatttgtgaccgttcagagtgtgctcagtgaacggcaagagcggctggaagtccggcagttatttgacgtttaccattcagatctattagataaaaataaacatacccgagcgtacattgggttatataagagtgaccgtcagaatgcgtttgtcttaccagcaccggcgcaaaagaagagcgatgcctttttcaaagaggtgtacgataagacggtcaaagaattattccaagaaatgaatctaccctatacgttacggtaagctaagcagggagatgtcagaatgagtgacattacagcagcacaaacaactttacaacaagctcagcatatcgtttttatgacgggagctggcgtttcgacgccctcgggaatccccgattaccggtctaaaaatggactgtataccgaacaccataacgcggaatattatttaagccacgcgtttttggcggagcatccgctggaattttatcaatatttacaatccaatttatattatccagacgcccaaccgaatgtgattcatcaaaagatggcggcactgactcggcaagggcgggccagtgtgattacacaaaatattgataatttatatggggtggctaaaacggctcagctcgttgaatttcacggtaatctctatcaggtttactgcaccaagtgtggtcagcatgtcgattggcatgagtatttgaaattcccttaccatcagacagaccatggctacttacggcctaacgtggtgttgtacgacgaggggattgcgagtgccaatatcgaacgggcagttcaatatttacagcaggctgacctagtcgttatttgtgggacctcgtttcgggtgtacccgttcgccggcctaattgactatcgtaatccgaaggctcaagtgcttgcaatcaatgcggaaccgctccagttgccatttgcatttacgatggtgcaacaagatgcggtcgacttcttcgagggggtgcaggtctgatgataacaattggcttaacaacttggacggaacaccctagtttactgggtggtactgaaaagctgaccttaactgaatattcgggagtcctaccagtcgtcgaagtggacacgccattctatggtattccgaaagtgacgacggtcgcgaagtggcaaaaggccgtccctgataagtttcagtttattttgaaagcaaatcaggtgatgacgctgcatgacacttatgacgaaggggtctcgatggatgcgctaaagacagcttatcgggaataccgtgcgatgctcaaaccgttaacgcagcaccagcaattaaaagcggtgctcttccaatttccgccgttttttgaacggtcgaaccgcaacttccattacctacaacggatggtcgagtggttacccggtgttccaatcgcagtcgaatttcgtaaccagagttggtacgaggagagtgtcaaagatgcggtctttagttttctgaaggatctggggattacccatgtgattgtcgatgagccgcacgctttaaatgatggcgttagtttcgagccggtcgtaacgaattcgaaattggcactcttacgcttacatggtcgtaaccagcagggctggtcagccaagggcgctaactggcgtagccaacggactttatatcggtatagtgatcaagaactagctgaattcaagcaaacggtggaacagttacaacagcaggcggacgaggtttgcgtcatctttaataataattctggtggtgacgcggccgataacgcgatggcactcaaagagttgctaggcgtttcgtttggtgatttaggaccgcatcaactggacttgttttaaaatgatttatgagtgattgatgtgatactttgcttaattgaacgagttatcagttgaattactatgttggatcaatacagtcactatgaccgtgaaccgttgaaatttggtactacggttgaatattctttaattgatgaatcatgacaactaaaaatgtagcggtagttcggacattcaataatgtgagctgccgctacattttttggcacttacaccttagctaatcaatatggacttagccatctgatttgaaagcgaacggttgggatacatcatttggaagtaaagttagtgtaaagtcaagaagtagtttatgtaaattcctgtttagttttggtaataattatctcgttggtcgtggatacgatggcttgggactgccttaaaactaggcagttataagtaccttaattcatgattcttaggtgaattagggtgattgagaaaagtgcgtgattaagatacactgacttcagttcaagcaactaagtagttgcctgccactgtgtgagttgcagatagttatggcaggttgaagtgttgttgagaatcgaatgttaggtcataacaatatagattggggcggattgggtatgcaaccggatattatttgcgcaaatggggttttctgcgctgatggaaaagtcttattaacacgggaatcaaaaaacacagcttattattttcctggtggcaaggtcggtgtgggagagacgctaacacagactctgcagcgagaattaaaagaagagttgtcattagttgtgtcgccagatcggtttaagtgggccttcacccaccgtggtacggcctataatcaaccgggaaaaatagtcgagttaaattgttttttagttgcggggagtggcgcgctcaaagtcgactcggaagtttatgattataagtggtgtcggccggacgatagccggatcgcggaagtcgttcgtgaagcgctggcccgatattcgtgggttgttgaataataatagattaccaataaatgaccggttaaaatcaactcgtgattttaatcggttattttgtggtggttggttgggccatttgaagcatggtgcacagttgactagtctgccacgatctttgcgtgtggagaactcttttgttagtgtttcttaataaacacaggaaatatgatacaatataagagattctacacattggcccagcaacatgttattttagaccaagacgtgttgtttggacgcgtgtgatttgttcatggattttaatcaaagacatgcttaacgagttaatcataaaccagtttgaagggaatttacgtcatggcagaaacaaaaccaacttattatattacgacgccgatctactatccttcggggaagttgcacatcggtaattcatacacgacaattgcgtgcgatactttagcacgttacaaacgtgcgatgggttacgatgtttacttcttaaccgggacggatgaacacggcctcaaaattgaagaaaaagcagaaaaattgaacactgatccgaagtcatacgttgatgggatggcaaaacaaatcaaggatttatggcaattgctagaaatctctaatgacaagtttattcggaccaccgatgattatcatgaacgcgcggtccaagaaattttcgatcggttacttaaaaatggtgacatctacttaggtgagtacgaaggctggtactccgttgatgacgaagaatacttcactgaaacgcagctggctgaagttttccgtgatgataacggcaaggttattggtggtaaggcgcccagtggtcatgaagtcgaacttgttaaagaacagtcctacttctttaagatgagtaagtacgcagattggttgttagattattatcaaagtcatcctgactttattgaaccagctaatcggatgaccgaaatgatcaataattttattaaaccaggtctggaagacttggccgtttctcggacgagctttacttggggtgtccctgtcaagagtgatcctaagcacgtcgtttacgtgtggattgatgccctgacaaactatattacggcactgggttacgcaaccggcgactctgaagacttgtttaacaagttctggcctgccgatgttcaaatggttggtaaagaaatcgtgcgcttccatacgatttactggccaattattttgcatgcactcgggttaccattacctaagaaggtctttggtcatggttggttattgatgaaggacggcaagatgtccaagtctaagggtaacgtgatttatcctgaaacattggttgaacgttacggcttggatgcgcttcgttattatttagttaaagccatgccttatggtaacgatggtttattcacaccagaggactttgtggcgcgggttaactatgacttggctaatgacttgggaaacttgctgaaccggaccattgcgatgatcaataaatatgaagatggtcaattaccagcattcaaagccggtgtgactgaatttgacgctgacttagaagccacagctgccacgactattaagaacttcaacgcttgcatggacagcctgcatttatcagatgcgctggctgaagtgtggaagttggtcagtcggacgaacaagtatattgatgaaacggcaccttggcaattagctaagagtgacgatgcgaatgatgctgataagttagccagtgtgatggcccatttagcagctagtttgcgggtgattgctagtttgatcagtccagtcatgacgcatgcacctaaggaaatctttacccaattagggttggacccagcaactttagcaattgccgacttacaactggctgatttgccggctggtgcacaagtcgttgctaagggaaccccaatcttcccacgggtcgatatggatgccgaagttgaattcttgaagggtaagatgacgaaatccgacaaacagaaggggcgtaaagccatggaaaacgcgaaacatgaagctgaagtcgaacaaggctggaacccagctgagactaatttgaacctcactaaaccagcgattaccattgatgattttgacaaggtcgaattgaaagttgctgaagtcattacggtgcagaaattgaaaggggctgacaaactcctacaattccgtttagatgcaggagatgctgatcatcgccaaatcctttcaggtattgctaagtggtatccagaacccgaagaactgattggcaagaaggttatcatcgttggtaacttaaagccacggaagcttcgtggtgaaatgagccaaggcatgttactgtcagcagaacacgacggtcaggtgcaattaattacggtaccagataatatggtaaacggatcattgatttcgtaaaaactaaatgttgaataaaaaatcgggcgcactgactagtgagctcgattttttatttgtaattcaattgttattttagttgtttttgacaaatgggttaatctcccgtacagtagtacgaacaagaaatgaggtgagaacatatgaagtatgaacagattctcgtatgcgtctccgtagatggaaaaggacgtttttccgcaaattaattaaatttaggagacttaattaaatgaaaaacgtccaaaaacaagtgccatcattattactgttaatcacattagtgggttttccacaaatcagtgaatcaatttttacgccgatcttgccagcactcagtcaggcaatgcacgttagcgccagccacagccagctaaccatgagcagttattttgtggcttttgcagttggggtgctcttctgggggcaatatgctgactatcgcgggcgccgtgatgccatgttaggtggattagccttttatttgatcggtaacttagggttatatctgagcccgagctttacttggttattggtttgccgcttgatccaagctttcggtgctagtgctggttcggttgtgacacagactatcatgcgtgagagctttacgggtgttactggtgcaaaaatctttgctaaggtgagtgcggccatggcactatcgcccgccctcgggccactcatcggaggtggcgtccagactgtgttcggctatcagcatgtcttctcggtcttgatcatgatggcagtcgtaatactgctgtacgcagggtgttgcttgccagagactcgaccaagaacggtcaaagtggcctcttggcggcaacaaagcgttgtcgtttcacggttattgcacgatcccgtggtctggtgttacggcctattgattagtggtattaatggtatcttgtttagttattacgctgaagcgccgtttatttttgaaacgcacttcggctttagtgctgtgcaatacggtagtctcggtttagtcttagccgcggccagtctgctgggcgcattgctagtgaattggcttgtcaactattggtcaccaatacaggtcgctttaagtggcttaggattgagtttggtagcggcagttggcttggtaatgaccgctgttggcaatcacgtcattgggatgctgattgggatttttctagccttcttaggtctgaacatcaccttaccaaacgcgttgaatcgtgctttgattggctatgaaacggtgatggggagtgccagtggctggtttagcctgggttattatctactagtgagtgtgctaacttacttaatgagttggctccaccacggtagtatcgtgacattgcccgtatacatgttaggcgtggtcgtcgtgatgacggtggtgtatgcgggactgtattggcggcgtgtacgtcattaattttgcttgaaagcctggggaaacccaggctttttgttttagaattaccgtcttcttttccgaaaacttgcgtcccatggtaaaatcaactaagataacaaaagtcgaaaaggggttattacatgcggatttttgattctcatacccatttaaatagtgaagaattcatccaggaagtgccacgttacttacaacaagcggccgaccttgatgttacgcggatggcaatcgttggttcgaatacacaactgaacgccgatgcgattaaactggcggaaacgtatcctcagttagtcgcgattgttggttggcacccggaagatgccaaaaactatgatcaggtggctgaaaagttgttgattgaacaagtccaacatccgaaagtcgtcgcgttaggtgagattggactggactaccattgggatacgtcgccacaagacgttcagcggcaagtctttgcccgccaagtcgccattgctaaagagatgcaattgccaatttccgtgcacaatcgtgatgctttcgaagatacctataagatcttgaaagcagctgatattcgtgacacgggtggcgtcatgcatagctttaatggtgaccctgagtggctcaaacggttcttggacttaggtatgcatatttcctatagtggtgtcgcatcatttaagaatgcgcgtgaagtccatgaatccgtcaagcaaacgccactaacgcaaatgctggttgaaacggatgccccttatctaacgccggaaccataccggggaaagcagaacgaacccggttacacgcggtacgttgttgaagcaattgccaagttacgtgaaacgacgccggaaattatagcggcccaaacttatcaaaatgcagaggaattttttaagattgaaaaagattaaagaagtaattgtggttgaagggaaagatgacacgaagcgtctcgccctagctgtcgatgcagatacacttgaaacgaatggctcggcgatttccgaagccaccttagcccagatcaaaacgttgcaggccagtcgcggcgtgatcgtgttcaccgacccagacttttccggtgaacgtattcggaagacgatttcggcggctgttccgggtgtcaagcacgcctttttgccccgcaaagctggtgtaccaactaaggctggggggagcctgggcgttgaacacgcgagcccagcggcgatccaaactgcactcgcccatctatatacggagcaaatcgacgagccccaacagttaatcagtcaccatgatttgattgcggcgggcttactagctggtcccacggcacgtcaacgacgcgaacaattgggtgaacgtttaggtatcggatacgtcaacggcaaacagttgtccaaacggttgcaactatttcaaattcagccagctgatttttgggcggctgttgaccaactaaccacagaggagaaatgatgagtagagatttagatattgcgaatcccgcccgcacacgggcaattatgcatacgtacgggttacaagttaagaagagtttaggacagaattttttaactgatcagaacgtgttacacaacattgttgccactgctgacattggaaccaatgataacgtgattgaaattggccctgggatcggggcactgactgagtatttggcacgggctgcccatcacgttttggcttttgaaattgatgaccggttactaccgattttggatgaaacgttggctgactatgacaacgtaacggtcgttaaccaagatattttgaaggctgatttagccgcgatgatcagtgaacatttagatgacgagcggccgttgaagttagtcgccaatttaccgtattatattacaacgcctattctgatgaacattttggcgggggacgttgcttttgaaaatattgttgtgatgatgcaaaaggaagttgccgaccgtttggcagctgaaccgggtacgaaggcgtacggtgcgttaacgattgctgtgcagtaccggatggctgctgagatggcgatggtcgttccccggacggttttcgtgccgtcaccgaatgtcgattctgcaatcgtgaaattgacggcattgccaccgcggacacacgtgccatttgacgaagcagcttttttcaaggtcgttaaagcgggctttgcgcaccgtcggaaaaatctgtggaataatttgcaaagtctatttggtaaacaacctgagacgaagacggccattcaacaggctcttgatatcgcgacaattgatcctaagattcgtgccgaacggttgacggtcgatgaatttattacattgacggatgcattacatcaggctgacttactttaagttatctatgcttataaaatggttgcacattagaaaaccttgtgatataatattgacttttttgtgaaaagctagtatagtgtctttcatgaggaggattctcaatgccaatttcactagctgcaattaaagataaacttgactcacggatcggccaacgcatgaaggtcgttgcccaggctggccgtaagaaaacaactgaacgccacggtattttgaaagaaacttatcgttcggtgttcgttgtggatttagatcaacaagaaaacgcatttgaacgggtctcctacagttatactgatgttctgacaaagaacgttcaaatcgcttttgatgatgaaacaactgaagcttaattcgcgtctcgtgaattctcaatattaagacccccaagcaaggtctttttattttgccttgatattagtataattgtatcaaagtaagtcagcgaccccgggtaatcgcggtcatggaagagggtgagacgcgtgcagatcgttgaaaaagcaccggccaaaatcaatttaggactggataccttatttgaacatccaaatggggataaagagtgggacatggtgatgacgtcggtcgatctggccgactatgtcatgttagaatcattgcatacgaaccgaatcgaagtggtcaccgatagtggctttttgccgaatgatcgccgtaacttagcttttcaagcggtgagcgttttaaaacggtattgtcatgttgatcggggtgtccgtatcaaaataagaaaggccattccggtagcggctggtctaggaggcggctcatctgatgccgccgctgttttacggggcttgaaccggatgtggaatctccacttggacttagccacgttagcacgtttgggattgcaagtagattcagatgtgccatactgtgtctacagtcagacggcccacgtgacgggaaaaggcgatgtagtcaccccgctacctaagttgccgccgatgtggattattctcgcgaaaccgaaagtcagtgtgtcaacgccaaatattttgcggcaggtcaattacgagcgtatcgaccagcatcccaatattgaggccttgttgactggcattcaacggcaggattttgcgaagatttttgcgaatatgggcaacgttttggagccaattacggcaaaacgctaccccgagattttacagattaagcggcaattgttaacgtttggggcggatgcggcccagatgagtggtaccggaccaactgttttcggtgtgtgtcgcaaacaatcgcgagcgcaacgagtgtataattccttgaagggtttttgccgggaagtataccttgtgcggccagttaatttaaatgaacattagaccgcagtagtccgccgtgatggtggactttttttattgatacggggttgaatgagccgagtctctagtttactgccacggttaaatggtagcgctgagccatttgctatcacgacctgtgtccagccagagatggtgtggtagtgcaattggcacaggaacgcgagtagccgcggctttgcttgcagattgacacacgaaaatgatcgttgctttcaccgtgtaatcgtttattcagacaacgcaatctctttttgtaagcaatttatgcgcgtttatgattaaataaggagtaacggaggtgttcggatgaagcagtcgacaaaatttggattgaaactggcgggcgtcgttggtgctgcaacttatgcgggaacgttacttggtggcttagcggcgtatcaagtcgcgatgcacgtgagtgacgcacagaagcagcggggccgcgaacgttcgcgggcagaaaacactgaaattgagaatttttggtatttcaagcagcctaaacagcagtggatgatccagtcctttgatgggctgaacttagtcgcaacatatatccctaatccgaaaacaattggccgcttggcgattttggcgcatggtctaggacattcgcgcgaacaaatgattccgtatgcgcgcatctttatgagcttgggatatgacgtcttgatgcctgatgctcggtcatttggtgatagtcaaggccatacgattggttatggttggctagaccgactagattatgaacgttggattacgatggcgcttagtcaattaggtctggatattgacatcgtattgatgggaatttcgatgggggccgccacggtcatggcgactagtggtgagctgttaccggagaatgttaaagctattgtggaggatagcggttatgcggatctttatgatgaagcgaagttcagactgactcataagttccacttgccagcctatccgattatgccggtggcgaatcgcttagcacacgtccgcgcgggctatgggtttaaggatggccggattctgcaacgggtgattgatggtgggttaccgatcttgatgattcatggttccaaggatcagacggtgcctgtccgcaatgcacataccttgtacgaccagttaccacaacaaaagggcctgtatatcgaccccgatgctggtcacgttgaagccatccgaacgcacccggatcgctatcaagaagtgttggatgaattcttgcatgagcaggcggggttggcttaagcaccttaaattaaagtaatgataaacatgaattgaccgtgttttaccggcttaacggtaaaaacggtcttttttttgcaatctcgtcttagtgataagcgcattcaactagtggtcaaggtgttatttgattaggcccccgatgattgctgcagctggtaatgattacggcattttgaactcaggtattgacaaatcaccgcattcaggtaaactaaaatagtaatcattacgatttactttaatttagaaagttggggtagtgttatgacggaaccgttaattgccgtccaacaccttggaattggctttccaaacaaccaggtgtttaaagatttgaattttaacattgaacaaggtgactttttgaccgtgattggtgaaaatggggtggggaagaccactttaattcgcgccttgcttggcatgctgaagccaacagccggtcaaattaagtattatccgaataaaaaagctattaaaattggctacgtgccccaatttcgcaacttagaccaggagtatccgttaacgattgaggactttgtcgggctgaacctaaaagggtggcagccgtggctgtctcgagctgaacatcgtcaggtagcgacagcattagccgtgaccaatttgaagaaactccgtcagcgaccgcttgggatggcttctggtggtgaaaagcagcgggcttacttagcacaagcaattgtgcaacaaccgcagctattaattttagacgaatcgacggctagtctggacaatgaaatgaagtatgaattgttggacctcgttcagaacttaaaccaaactagcaacattaccgtcttctttgtgacgcacgacttgccattagcgaagcaatacgccaaacattatctggccttaaagcccggccaccagcaatttggcaatatcgctgatatgtcggtagagcaattaaaggaggccactaatgtcaatgtttagcttagtatttatgcgaaatgcctacttagcaggaacctttattgcaattatttgtgggacgattggcgttttcgtgattgcccggaacctctcatttctgacacacacactgtctgaaattgggtttgccggtgcagccttcgggatttttatgggctggaccgcgttgagtgggatgctgatttttaccgtgattagttcggtcatcgtggggcagatgagtgtgaaacaatcacgacgcgaagcctcgatttctgcaatttccgctctgtttatcggcttagggattctattcctgtcgttatctaatcaaacttcgagttatgcgacgagcatcctgtttgggagtgtgattgggattgccagtgcggatgtcatccgggtcgcaatcttatcggccatcgtcctattcgtgatgttgggcttgtaccggccactcaaatttgattccttcgatgcgattggcgcccgggtgagcggcttatggacgaccggcatctcagtggtcttcttggtactcgttgcgatgagcgtcagcgtggctgcccaaattgtggggtcattactgatctttatcttactcacgttaccagcagcggcagcgcgatactttgtccatacggttagcaagatgatttttctagcgattggtttcgcgttgattggggtttggctggggctgtacttgagttacgtcacgaatttaccagtcagtttcttcatcgctgcaatcgagtgtatcttctactttgccgcgctgggttatcagcggttgcgcgttggtagttaagctgttgataccattactgataatcaaaaaaattgtgtggggcagttatctgactgtcactgataagcaagctttcaagtggttaacgacttcttgaaagcttttttgttgtaccgactgagttgtacacccgttgctgttatttatgggtgattttgatgactgatttggtccattctagtttattgttctcaaattcgtccattattaggtgtactgaccagaatattggcaaacatattaagaaattccgatggtttagtaaaaaaatgtgaaaaaattagcttatttccgaacgtttgtgttatcattttgcatagactttaaaaatgagatttaggttgaggtggaagttatgaaagtacgtagaagcgaacgtttaatagatatgacgcgctatttgttggaacgtccccatacattagtttcattgacatacttcgcggaacggtacgcatccgcaaagtcgtcaatcagtgaagatttaacgattttgaagaaagtatttcaggcccggggaacaggaatcttggaaaccattcccggtgctgctggtggtgcgcggtttattccttatattttaaaggaagaggcccaagaatttattgacgagatgaccaccaaggttgccgacaagagtcgggtgttaccgggtggctatgtttatttatctgatattttaggccaaccagatattttgcgccaagtgggtcgggtgattgcgactcagtacttgaatcaaaaaatcgacgctgttatgaccgttgcaactaaaggaattccgattgcccaaagtgttgcgacttatttaaacgtgccgtttgtgattgtccgcaatgattctaaaattacggaaggctcgaccgttagtgtgaactatgtctcgggttcttcagaacggatcaagaagatggaactttccaagcgaagcctaacggaaggcgccaacgtgctcatcgtggatgatttcatgaagggcggcggcacaatcaacgggatgaagaccttgattgaagaatttgatgctaatttaattggcatcaccgtttttgccgaagccagttttgttggcaatcgtttaatcgatgactacacgtcgttattacgagtaaccaacgtgagtgatagtgacaaggcgattaaagtcgttgctggtaactatttggagaaggttttcggtgcggaagtctagcctggtgtgttatccagaccagttttttgatatgatggacttatctgaggactaaggagtaatttgtaatgacaaccaaaaatgcaatcatcatggccgctggtaaagggacccggatgaaatccaagctagtcaaagtattacatcaggtctgtggcaaatcgatggtcgaccacgtcttgacccaagttgaagccacccacatggcaaatatcgtgaccattgtaggccatggtgccaaagatgtggaagcagccttaggcgaccgaactgagtacgcggttcaaacggaacaattaggaaccggtcacgcagtattacaagccgaatcgctcttaaaagatgcggatgggatgacgctgatcgtcagtggcgacacacccttatttaaagctgaaacttttgaagaattatttgaatatcatcaagctaagggtgctgctggcacgattttaacgtccaaggcacctaatcctcgaggctacggccgggttgttcgcaatcggttaggcatcgttgaaaagattgtagaacaaaaggatgcgactaaggaagaacaagaaattcatgaaattaacacgggagtctactgcttcgataatcagaagttgtttgccgccttacatgaagtgaccaacgataatgcacagggcgaatattatttgactgacgtgattcagatcatgaagaatcagggtgatgtggtcgccgcctatcaaatggatgattttgatgaatcaatgggggtaaatacccgtgcagctctagcccaagcaaccaaagtgatgcaacaacggatcaacgcgcagcatatggaaaatggggtttcaattatcaaccctgacgatacctatattgatgcgggcgttaagattggtgctgatacgattattgaaccaggcgtcttgatcaagggccatacgacaattggtgaagattgcttcatcggcgcgcactccgagatccatgacatggtgattgaagatcgtgttcgggtgacggcttccttcttggaagattccatcatgcacgccgacagcaacattggcccgtatagccatttgcggccgcaagctgagattggtgaacacgtccatcttggtaactttgtcgaagtcaagaaggctaagatcggtaatcggaccaaggtcggccatttgacttatgttggtgacgcaacgttaggtcaagatattaacgttggttgtggcgtggtcttcgttaactatgacggagtcaacaagcaccacacgaatgtcggcgattccgcctttattggtagtaactcgaacatcattgcgccagttgaagtggctgaccactcgtttatcgcggctggttcgaccattactgatgatgttaacttccatgatatggcaattgcccgggcacgtcagacgaacaagcctgacttctggggtcgcttaccacatgaaccagaaaatatgtaattaccatcattgatgatgaattcagagaccatcccagtgcgctgttgctgggacggtctctttttgtgtgcgcagcagcctgacctgtcacgtcataaggcgctattggtctgttaaatcggcttcgactgggtcaattcggatcaaccgagtgattttaattgagctatgaaattggtataattggcgaggagttaaagggatggaaaagtttggaggcattgggatgcagacaaagaagtggattcgcggccttgtttgtgggctggcgttgcttggtggttggagcttagcactaccagtacacgcaactagcgttaaaagtgagcaaacagccgttaaaagcatcgcgcaacgtgatttgaaatcgctaggcggacgctggtcagtcaaggtgacccgattaggccggcgaaagctaactgtgcagacgggaaaccagcgtgtgacccggcaacgttccgctagtacgatcaaagtttacgtcatgctgacgatttatcggcgggtccaacaacgaaagttacggctaacccggcaagatcaacgtgatttaaaactaatgatccataattccgacaataacgcggcgaaccgcttgatcaaacgtgcggggggcttcaaggccgttaatacgaccattaagcattatcgattcaagcaaacggttttacaacggtacatgctcgatacggatgcactgcgccgcggtcgcgacaattacacgtcggtgacggacctgacccgttttttaacgctgacatatcaacataagctattaggcaaagcgtatgataagaagatgctgaacctactcaagggctgtcgcaaccacagcaagctaccatacttagttaaacacgcgacggtctataataagactggtgaatatccggacaagggcgtccaaaacgacgcggccatttttaagaccaaacaaggcacttatagcattgtcgtcatggctcagaatggccagcagtaccaacaatatcaagggatgaatcgcttggggcgcgatgtcgtgacttatttaaatcaacaccgctgagtgtgtttaggtaactgaatagtctagtagatttcatacgcacgtcttattccgactctcgggcctggctgtttttgaacttaagaaagggcagcggttaagcaccgctaagaacataactagtacaatgtgcgtgttagtaacgattacagctgatagcggtctcattaactgtgattgttcggaaattggcgctcacgaaactttaatctttaatcacgaaggggcgtagattgccgaaagtcgtgcttccagcccagtctcacgcaattatgccttgttgttgggacttgattttcactagcaaaatgcctattatttagtaagtaataaattttcgaatggaggaaattatgtcagaacagtattttgatccaaagttaaaaatctttgctttgaattcaaataaaccattggcagaaaaaatcgcggacgccgttggggttaagttaggtaagacctcggtcgatcgctttagtgatggcgaaattcgcattaacattgaggaaagtattcgtggtgaccaagtttatatcattcaatcaacttccgctcctgttaatgataatttgatggaactattgatcatgattgacgccttacgtcgtgcgagtgctaagaccattaacgtggttattccttattacggatatgcgcgtcaagatcggaaagcccgttctcgcgaaccaattaccgctaagttagttgcaaatatgctggaaacagccggtgcaacgcggattttggcactcgatcttcatgctgcccaaattcaaggcttcttcgatatcccgttagatcacttgatgggtgcgccactgttagctgactacttcctgaaccaccacttggatgaaaatgctgtggttgtttcacctgaccatggtggtgtgactcgggcacgtaaattagctgaattcttgaaggcaccaattgcaatcattgacaagcgtcgaccacgggccaacgttgccgaagttatgaatattattggtgacgtcaagggtaagcgggccatcatgatcgatgatatgatcgatacggccggaacgattactttaggtgctcaggcactggttgatgcgggtgcaactgaagtctatgctagttgtacgcatccggttctgtctggtcctgccatcgaacggattgaaaagtcaccaattaagaaattagttgtgacggattcaattgaattaccagctgctaaacgaatcgataagatcgaacaagtttcagttggtcaattaatggggcaagcaatcaagtttatccatgaaaataaaccagttagtccattatttaagaatcgtttccataacgaagaaaattaatcgacgaagcgtcaaattggcaattgctgatctgacgctttttaagttgcagtaatttctaaaagtgataaagtaaaggtgttgtttggtgggcattgtgacctagtcaaagttggactggacgccggatatcagcgaatctttcgtttcggcgtgtttcgacattagttaggtgatggcgcggaacggataacggaccaacgtcgggttaccggcgcctttttttatccataaacactagcacgaatccttaaaatgattacaatataagttaagggggtgttgcgatgacaccattttattggggtagtttagcccttgctagtgcggtgactttgcaattaacggaccggcggcattggttaacgggacatctttttttgattgcagttatcggcattttgttaagcgcttactatcgtttcagtgcgcaggcaagccccacttggcaatttatgctggtcggtgcaaaaatcgtggcttatacgttattgccgattgtgattttgatcgtaggcattagttttgtcaggtatagttaccggctgattcgtaaggaaggctgggcgtttcattacagcttgctagcaatcgttggtggcgtattagtcataatgttgattctatcagtcatcaacttaggcgtttggcactcacggcgcttatggcagttcttaggcctggcgttgttattgacggcgtattttgcgttcagctttttcgcctacctattagcttgcgtcacgaccaggttgggtcggcaccgacaaatcgattacatgatcgtcttaggcgcgggattgatgccgaacggccagccaacgcgaacactagcatatcggcttcaggcggcagcgaagtactaccgggcgcagcgggcgcgttatcatcagccaatcacgatcgttgtttcgggtggtcaggggcctgatgaagtcatggctgagagtaccgcaatgcggcagtacttggttgatcagggggttcccagagacgccattcaagaagaaaatcggtcaacgtcgacgattgagaatctaaaattttcgcacgcactaattgtgcggcagcaaccgttttatcgcgccgtgattgtcacgagcggctatcatgttttacgggctaatatttttgctcggcagctgcacctgaacttaacgggaatcggggcgcacaccccactgtattatttgccatttgctatgtttcgggaatacttggccttaattgtgatgtatcggtgggccaacttagtggcggtacttggtttaacggcttattacgtggcggcgttagttaggttaatttagtataatcgcgtctcggagctttgaaaaaactgacattacgattaatggtataatggagaatgataaaaaggaggggtttgccgtggatcatgcctatcgatcatcttggccactgtttgtaatcgtcctgattggattgattacactttcaggctgtgccaaaaataccggaggcgtaaccgcaagttcggccacgaccgcaactggtaacagtacaacggccgttttaaccaaagctgatcagcaaatttcgcaacaaaaaattgccgctgcccagaagactttagcgggtgcttctgaatcaactccagcgatcaaaaagttagcccttgggttaaagtattatcaggaagctgaagaagcgcttgataataatcagctcagtctagcaaagggttactttgacacgttaagtagttatgatggcacgactgacgccagttttattgcagctcggcagaagcttgtcaagcagtaccaggcggtcaagctagccaatggttactataacgctgcccgtgatgaattaagtatccatgatttggccactgcgaaggccaatattgataagttggacgatgtgcaagcgacacatccggttatcaaaaaattacagaaaaaagctttggccatgaaacaagccattatgaattatgaggcgtcgcaatcgactagttctggcagtgatagctcaacggtcgtcagttcaagttctacgtctagtgcgagtgatagtagtgcgtcctcaagcagtacgagtagcactagtgccgatagttcaacgatgacaagttcgtcgaatagtagcacgtctaccagtagcagttcttcagagctgacgacttcggcgatcatcaaacagtttcaggatgcgtccggtgttacgtttgcttcggataccgaatttaatatcactaaggagactagtgcttactatcagattaccgcaatttatgcggcggatgagtctagttcctccgcttccaagacagtaacggatacttatcgttactatccggatagtggtagtgttactaaggaaaatagtgcaactggtagtttcgaataaccagcattaaaaagtgacgatcaggtaatgactgatcgccacttttttgcttgactggattattcgagaaatgctgagtaatcatagtagtggtaaaaaaaagcaacgctaacggcgcgttaaaacgcgctattagcgttgcttgaaattagtttgaaaagtcgcttaggcgagtgcccaagtgttaatggcgtgtgcgaccccgtctttaacgttagtcttggtttcataacgggcgatttgcttggcctcatcaatggcgttacccatcgcaacactgttggtcgcgtaacgtaacatactcaaatcatttccctgatcaccgattgccatgacgtcatcgggacttaagtgcaaatggtcggccaatgtggctagggcgttacccttgctagcggcgggattcatgaattctaagaaatacgcttctgagcgaacaatggtaaagcgcttggagaatgacgctggtaattgcttgatggctgcatccagtagtgggccgtgatcgatgaacatgcacttgacgattggtaagtctgggcgcatttcttcgggcgtccggaaccgaatcggcatgttgacgagggcactttcgccgaccgtataagggctgatatttcgattggcggtgtagatatggtcttcactttcaacgtgacaatggatattaagcttgcggctgagcgtttcaatgtcgatgtaatcgtcatgtgatagcgtcagtcccgtgatgatcttaccggtgatggtctgaaccattgaaccattaaaagtgatgacgtaattaccttcaccagcgatccccagttgctttaaaaagggcgtgacgccacttaatggccgtcccgtacaaatgacgactttgattccttgcgcattggcggcgttgattgcttgaacggttgcgggatttagttcgctgtgctcattgagtaaggtgccgtccatatcgatggcgataagcttgactgacataataataattcctccaaaattagtgtggtacgaccagacgatcgtttaaaatatattgctgaaattcttggtaaattggtttaaataaatcgttttcggcgtttttgctgagcatttcttttggaaagaaaaaccgctgatcgccagagactttcccggtgatagctcgcactaggtcactgacggtggatagttcgagtaaggaaccgtctttttgttgcagttcaatctgggtacgcggcttcttcatcttaggatcataggcgtcgtaagggagatcgtaactgtcgttgatgtcagtgtagtagtgcgtatcaaagccggcttgttcaattaatttttgtaacgttggaattagcggctgagtcgttgcatcgacccgggctgattttaagggacgccggtctaagaaacgggttgcgaggtcagcgagaatttgatcacggctatcacgccaatggctgaaataagtgtttaagacgccatcgtctaaccgtaaataatcgtgtaacgtaaagttattgttgaaaaacggcaataacatcactggtgtcgcttcagcatcgaccgcgtggctttgataaagatcgttagcccgctccagtaggcgatcgaggatgacttccatggaacgtgatactggatggaagtagacttgcatgtacatctggaagcgactgacaatgtaatcttcgaccgcgtgcatgccttccattgcaaatgtaatgccgccttgatacggcttcataacgcgcaaaatacgggtcaaatcgaaattaccgtaattcgtacccgtgaagtacgaatctcgcagtaggtagtccatccggtcggcatcgatttgactagagatcatctggacgacttggggattcggatacgttttttgaatgacggctgcaacttgggccgggaagtcaggtgagacttgctgtaagacctgattgacctcggtttcaggtgatgtcagaatctgaacagtcagggcttcatggtcggtgtggaagatgtgctcgaacgtgtgtgagtatggcccgtgaccgatatcgtgtaacagggcggcgcatagtgcgaccaatcgctcgtggtcatcccaaccaccgtcaccaggggtctgggtcgggtagttacgttcgaagttatcgcaaatacggcgggtaatctcataaacaccgaggcaatgcccaaagcgggagtgttccgcaccgtggaaagtcagcgaggtcgtaccgagttgcttaatgcggcgcagtcgttgaaattccgaggtgttgatcaaatcgagaatgacttgatgttggatataaatataatcatggaccgggtcacgaaagactttctccatgggtaatagttgctggcgataggccaaattaattccttctttcagtgatgcaagcgttgttgtcgccgttgcatttgttgataggcttgatttaagtgtgcttgaaattcaggttcttcggtgactaacggcaaactcgtcgtgtcgaccgtcccatgttgagctaggatggcgataaagcgagcttgtgcggcggtagtgtcagtcggcgttgccaaagtgtcggcaacggtcgtcatgacttgtggatcaacatctggaaaccgctcgtcatggtgaccggctaagctgacttggtaaaaacgctgaatgagttgactacgggccatctgatcgccatcaacgctgacatacagcatgatgaccagcgcttcggcagtgcgccgttgcgacattccagcaattttacgaccggcaatactcaaatcataatcaccgggacaataggagcgtgtaatctcaccagtcgtgatatttaattgtggccacactgcctgaacgtagtcgaccatcaattggtatgccgctgtaattgaatagcgttcacgagttgctgggagaaataaggagacgtttagtacaccagggtcagcaactacggctagcccacctgaattacggagcatgacctgataaccggcagcgtgtagatctgctaagccagcagttagccgtggcaagcgttggtctaataggccgagaatgacggttggctgtaactgccagaaatgaacgattggttgctgacgagccgccgttaaccacagcagggcgttcgtgtacgcaaaactatccagcatcgctgccggttcgtatttttgactcaaagttgcaattgttgattctgtcaagaaagccaccccgttatccgctattgccggacacgagggatgtttcgtgatgaaaccgccaccgttgtccgtatcatcaccaattatactagaaaaatggtaccggtgcattggcttagacaaatcaacgtaatccgtagcatgccagcattaggatgaatgcaacgtgcaagttagttggctttttgttcgtcagcaacgtgcggcctatttcgacctccggagctgagggacaattgttggaacacagccgactcaaaaagtttacgcgagttcgaacttttcccagcaggtctaagttgaccgcttttagtcctatttttagttattttggcttgaatggcttataattaaacaggaagttttacgatgggcgtgatgagagtcgcgcggtcgtgaacgctgaaaaggatatagcgagtgtggtaacacggtgatcgtagacgggcgttcagcgtgtgattttgaaatattaggaggcccaactatggatgatttaacaactggcgtgccagtggcgattcatttagagacgcaggcgcggcaagatgacgatacggcgaactatgcactggatgtcgatggtcaactagttcagatgggtgacgcgttttatttacggtataaggaagttaacgatgacgcgccagagccgattccagtgacgattaagctggcagctaatggggacgtcgtgttgacgcggagtgcggagaaccgacttcggttgcacttttccaatggtaaacgggtgcgtgctcattatcaaacacccatggggatgctacctgttgaaacggtgacgccgatgttacgagtacggctacgtgaacggccattttcaggtgaggtgaacgttgattacgatttatacgcgggtgaacagctacttggtaactacaagttgcgattgcaattcacggcctaatttggtattatgtactataaactgtggaaaggacgtgcaccagtttggaactaaaacaatttgatggacaaaaaaagtccgaattatctttaatcgaggttgctcacgcgatcttatcacaacatggtgatgtgatggcttttgccgacttgaccaacgctgtgcaatcatatttaggtaaaagcgacgaagaaattcgggagcgtttatcacaattttataccgatcttaatatcgatggtagtttcatttcgctcggtgacaatatgtggggcctgcgtgcatggtacccatttgaatccattgacgaagccgttattcatacggacgatgacgaagatgaggatcggccaaagcgcaagaagcgtaagaaggttaacgccttcttggccgatgccggggatgatgacgacgtgatcgattacgatgacgatgatcccgaagatgacgataactacgatgacgatgatgatcaggacgacgatactgatgattcagcaagcagcaagtacgatgaacttgcgggtgttgatgacacagacgacgatgttgctgatgaaacgttgccagacggtatcgagggtcaattatcagagttaaatgatgacgatgatgatgacgactacgatgacgaagacgacgaatcgaaataagcttttcaagatttttccttgacgaaaagggaatctccttgtattatcttatttgggctctctggtagaaatacctgagacaaacgatcgtattagctccctatttctgctgaaatagggagctttctttatttataccaccccacgaaataaatctttaaggagttatcacatgaccaaatatatttttgtaactggtggcgttgtgtcatccattggtaaaggtatcgtcgctgcttcgctagggcgtttattgaagaaccggggcttaaaggtcacgattcaaaagtttgatccctatatcaacgttgatcctggtacgatgagtccttatcaacacggtgaagttttcgtgaccgatgatgggaccgaaactgacttagaccttggacattatgaacggtttatcgacattaaccttaataaatattcaaatgttaccaccggtaagatttattcagaagttctgcaaaaggaacggcggggcgattatttaggcgccacggtgcaagtgattccgcatatcacgaacgctatcaaggaaaaaatcatgcgcgctggtacgacgacggattccgatatcgtgattactgaaatcggtgggacggtcggtgatatcgaatccttgccatttattgaagcgctacggcaaatgaagagtgatttaggttccgacaatgtcttctacatccataccacgttgatcccatatttacgggcagctggtgaaatgaagacgaagccaacgcaacattctgttaaggaattgcggagttatgggattcagccgaacatgttagttgtccggactgaacaaccaattacgcgggaaatgcggaataagattgcgtccttctgtgacgtggaaccagaagcagtcattgaatccttagacgttaagacgatttattcaattccgttgaatgttcagaaacaaaacatggaccaaatcgtccttgaccattttgatgtacaggcacctaaggccgacatgagtgaatggattgacttagaacatcatgtccagaacttatcacgtaccatcaagattgcgctagtcgggaaatacgtcgctttacaggatgcttatatctcagtgacggaagcattgaagcatgctggctatacggatgatgccgacattgatttgaagaagatttctgctgaagatgttacgccagaaaatgtcgaagaactactcggcgatgctgacggaatcttagttcctggtggctttggtgatcggggaattgaaggtaagattacggcaatcaagtatgcccgtgaaaacgacgtgccattcttaggtatctgcttgggaatgcaaatggccagtgtcgaatttgcacgtaacgtacttggattgaaggatgctaactctgctgaaatcgatccgaagacgccggacaatattattgatttgatggccgaccaagaagacgttgaagacatgggtggaacgcaacgtttaggcgcttacccttgcaagctgaagccgggaactgtggcggctaaagcctatcacaatgaagaagttgtgatggaacgtcatcgccaccgttatgaattcaataataagtatcgtgaagcaatggctgctaagggcatggtcttctccggaacttcgcctgacaaccggctcgtcgaagtgattgaattaccaaagaagcgcttcttcgtggcctcacaataccatccagaattcttatcacggcctaaccgtccagaagggttattcaaggcattcatcgatgccgctaaccagactggtaagatgaaggcataaattcgaaatataagtgctgtcaaaaaaacgcgtactagcttgaatggctggtacgcgttttttgcgtggttatggggtggtttagaatatcaaagttccaacaatgcggtagcagattggctatcagtaatcaagacattagcatagccgcccattaaggcaccgtgaatggatggcactttcctactagatcccgctaccagaatcgcgtattttttatgcttgagtgcttccaactgaattccgacggtacgcgcattgattgcggagtcagcaatggtcccatctttggtaataaaacgagagacgatatcaccaacagaagaagattgaagccgcttaatttctgcagcgtttaggtagcctagattgaatagcatcgcatccgagcgcacggttccgctggtaaatagggcgatattggttgcttcaccggctctgatgatttgagaaataaaccgatcgtcgaggacgatttttttagtgacgggatcatcaaaaattaccggtagcggtagtgtaactgcgttagtatgataggccgcgctaaatttggtgacgatatcgttggcgaagttgttcatatcagaggcagcgacacttccttttaattgaacaatacgaacgtcgttacgggtactaatatgcaaatgatctgcaaccgctttgatcgtctttccccagctaatcccgatggaatcgtggtcttgtacgatggtttgcagataatcagcagtcaattctccgagtttttcattgatgagttgactatcgttgctcgcatcaaaactaataaggactttttttaaatgatacttatgttctaattgttgtgctaaggtccctaaatcttttaatggatcggcaatttcaattttaaccaggccagtatctttggcataacttaggagtcttgaaattgtcggccgagaaatttggagctgtttgccaatgtcactttggcttaggccatcttcgtagtagaggtgacagaccttcaaggcgagttttaccttatcttgattgattgctttttccatatcctgacttccaatctttgaataacactttaattgtattcgttagtttatgattaattattttttgaaatcatgactgtttatttaactgcgaataaggtgatcaaacaaaccgtttttcagcagataaagtcgatggtagtgcagatggctgatcaatctagcctgagtttgattgctgaacagtccgttgttgataacccttttcagtatagcataaacgccaaagtgaacaaaatttcaaatgcagtgtttacaaatgttcaattcgtgatatactgaagttgttaaaaagaaaggggtttcattaatcatgaaattgaatcgttatttagatcacacgttattaaaaccggaagcgactgagcaacaaattgatcaggtagtacgggaggcactcgaaaatcacttttattcagttatggtcaatccatactgggtcaagcacgtccatgcgcaacttgctggttcggatgttgcgactgcatgcgtgattggtttccctctgggcgcgaatacaaccgccattaaagttgcggaagccaaacaggcaattgctgacggtgtggatgagctggatatggtcattaatatcggcgaattgaaaggcgaccactatgatgaagttcaacacgacattgaaagtgtggtaaccgttggacatacggctgataaggtcgtcaaagtgattattgaaacggcgctgttgacggatggggaaatcgttaaggccagtgaaatcgttgccgatgcacacgctgattttgtgaagacatcgactggattttcaacccgtggtgcttcggttcatgatattagtttgatgaagggtgccgttcaggatcgaatcggggtcaaagcatctgggggaatccatacacgcgatgaagcattagcgatgattgatgctggagcaacgcgcctcggtgtatcagcaagtatggcaattattggtaagtagtgatggctgaatgatggcgcaccattccagtttaaaaaagaaagcgctaacatcaaggaggggaaccatgcaaaagttatttcggggtgtgattaagctatcagcccatgagcaagatgatggttatttggataaaacaccgattttccagttcatgctattgtcattactcattcctttgtgggctgcggcagccagcttaaataacatcttaattacgcaatttaagactatttttgaattgaataatgcaacgagtgccttagtcaacagtgcattttatctgggctatttcgtcattgcgattccagctagtcgggttatcaaaaagacgtcgtataagttagcaatcgtaatcggactgagcttatttacgattggctgcttgctctttttcccagcgtctcacttagccacatacggggtgttcttaattgcattatttgccattgcatgtggacttagctttctggagacgagtgcgaatacgttcagtacgttgatgggacctaagtcggcctcaaccgttcgactaaatatttcacaaatcttttatccgattggtgcagtcgttggaatcctcctgggtaagtatttgattttcaacgatggtgctagcctggcaacgaccatggcaaaaatgcatggtgctgctcggttagcctatggacagcggatgttacagcagacgctgctcccgtataaatatctgattgtggtgttacttgttgcaatttttatctttgttttgacacagtttccaagtggcaagcctaaacaacgttcagatcaagcagccgcaaaatcagctggtgtcggtgaaacgctacgttatttgattcataataaggactttacgaaggggattggtacggagtttgtgtatatgggcatgcagacggcggtctgggcatacacaatcaacttagcgatgagttttagtaatcgtatcaacgagcgcgatgcctcaacctttatgatttatacctatattgcattcttctgcggcaagctattggcgaccgcgttaatgaaacggtttgcaacggcgcaagttctgtttggattttcagtagtggggaccctcgcattaggctatgttacctttgtccctaatgagtcagcggtctatctgacgattttggcgagtggcttgttcggtccggggtggccaacaatttattcacaaacgctggatacggttactgataaacgctacacggaaactgcgggagcaatcgttgtcatgtcgattattggtggtgctgtgacgccgttgattcaaggcttgattgcggacatgacgggttctgtttcgttgtcattcattatcgatgttattagttttgcaattgtaggtagttatgcacttagttactacaagcgtcatcaggcagcgagcgaagtcacacatatggaggagctattatgaaaacaattaagttatcgcatcaaatgtttagtcaatcagagtttgaactctacaaagatgataatttcagtgcaaaaacatttctatatccatctggagtagaaggcttgcgactgacgaatcagcgtggcgaattagtcgtgctgccattcatgggattgattatctgggatgtggtctttgacggtatttccttgaaaatgaaagatatgttttcccaaccattgccgggtaagggtattgccgacacgtatggctgcttccagtttacgtctggattactaggaaatggaacgcctgcacctgaggacgattatcagttacatggcgagtttccaaccagtaagatggcccatgcctatttgacgattggtgaagatacgttgacgattcatgcagattttgaatatgtcaaaggttttggcgatcattatttaagtgaaccttccgtcatgatgcgagcaaattctggactgtttgatattaatctagatgtgactaacttgtcacatgcgcaggcgatgccgcttcagtatatgtgtcatatgaattatgcatacgctaagaatgcccatattgaacagaatttaccggatgaagcatttaaactccggaaaacagtccctgctcacgttcatccaactgatgcatggttggcctataacgaccaactaaaagcatccggagaattgatcaatgatttaacggatgaagcgcactatgatcccgaaattgtgttcttctctcgcgacttaacgcagtataccgatgaagccgaatttagaatgcatttggatgactcacataactttttgactaagtttaagaccgaacaatttccaattgtgacacggtggctactctacaacgcggaccaacaagttgcagcgtttgccttaccgggcaccagtacaccagaaggcaaagcagctgcgaccaaagctggaacgctaattatgttggaaccacaagcaaaacggcactttagtgtgacgaccggattagaaaagtagggggacgataacatggcagatgttacagtaattggctctaatatggttgatttgacaacttatatcgggcggatgcctgtcgaaggcgaaacgattgaggcgccagaattcaacattggctacgggggtaagggtgctaatcaagccatcgcggcggcacgcctaggttcagatgttaattttattacgatggttggtaatgatgggtttggacaagaacaactcgctaattatcaaaaaaatggtattcgtacggatggtattggcattggtcatcaaaatagtggggtagccccgattttcgtagatccaagcagtgataaccgtattttgattatcaagggggctaacaaggaactgactcccgctgttttggatgaaaaacaggcactaatcaagaatagtaaactaattgtgctgcaacaagaaatctcgctagagactaattatcacgccatcgatctagcacaacaatttggagtgccagttctccttaatccagctcctgctaacaagaatttgaatattgactatgtctcgaaggttgcgttctttacgcctaatgaaacagaattagctacgctaactgggttaccaacaaataacctggatgagatcaaggtcgcggcgtgtgatttgattagtcgtggcgttgaaaatctgattattacgttgggtcataagggcgcactctgggttactgaaaaccatgcagaaatcgtcccaggaatgaaggttaaagctgttgatacgactggcgctggggattcatttattggtagttttgcccattactttgcacagggtgaagccatcccggacgcgttgaagcatgcgaaccagtatgcagccatgacagtgatgaaaaagggaacccaaaagtcatatccgacggcggcagaactttcagatttgttagctgctgcagtggattaaatgaattgcaagtgttgtcattatctgactaaagctcagataatctgaacgcttgcttttgcttgtccatcaaaaattcgctataaaaatcctcaaaagtcgtaactggtattgtgctgataatagtggctatacgtgttgtgttagttatcctttagcattaaatgtgattaaaaagtaccaattggttggcttattgttagtctgccgagggttgcccagaatgtctggaagccggagtaggacgcccccgcaacagtaggtttacgttaactcgcactgtttctagggggcttcagctggctgcttttgaattagaatgttaatcctcattcaagacccagtgaaataattaagactgcaataaatgattctattaataatagaaaaataaaatgatgataaaaaactattgacaataatcgatgggaggtctagattataagtgtaaattgaaagcgcaaacataatgggctagtagttaatctgattatttagaaagccaacggttgctgaaagttggttgattggactgatgaatccgccatttagcgtttggcctcgtctttaagaggtcgcggtgagacgatatactcgtagagcagtaaattgggtggtaccacgttggtaaaaaaacgtcccatagtcttttaggcgaagactatgggacgttttaattttaaggaggtttttcgtatgttaaatccaaagtttgttcgtaataacccagaacttgttaaggctaagctccagacacggaaagtcgatccggctgaggttgatgaatacttacagttagaccaacaaaaccgggatgcgattactaaggttgaaggcttgaagaaacagaaaaaccagttgacggaacaaattgggcaaagtgatccgcaatcggaagcgggccaagccctcattcaacaagtcaaacagctgaacggtgatattaagagtacggaagctgctcagacggaagtaaacgatcggcttcattacttagcgattcgcttcccgaacttacctgctgatgatgtaccagtcggtcctgacgaagatagcaacgttgagatgcgtaagcacggtgatattccaacgtttgattttaaacctaaggcgcactgggaattgggtgagagcttaggaatcctggattttgatcgggcagcgaaagtcgcgggcgcacgttttgtttattataaggatgcgggtgctctcttagaacgggcggtttacagctttatgctggatctgcacacacaaaagcaagggtaccatgaaattattccgccatacttggtgaacgctcagacgatgtatgggactggccaatttccgaagttcaaagaagacgtctacacggttgaatcttcaggaatgacgttgattccaacggctgaagtaccgctgaccaattactatgcgaatgaaatcttatctgaagatcagttgccaacgtacttcacggcgatgaccccttgttaccggtccgaagctgggagtgcggggcgtgatacccggggcttgattcgtatgcaccaatttcacaaagtcgagatggtcaagtactgtaaacctgagaattcatacgatgagctcgaaaaattaacggataatgccgaagaagtgttgcgcgaattagggcttgcataccatgttatcaaactttcaacgggggatactggtttctcatcagccaagacctacgatgtggaagtatggatgccagaacaaggcgtttatcgggaaatcagttcatgctctaactgcttggacttccaagcacggcgggcgatgattcgttatcggaaagctgatgggacggtcgattacgtccacacattgaatggctctggacttgcagttggccggacggtggctgcgattatggaaaattatcaacaagctgatgggacggttaaaatccctaaggtactccaatcatacatgcatggtatgacagagataaaataaaattattatgagaataaattatcattcaaataattcagttgaatgttaaacttaatatcactaggattgagatggatacaggctaggtctgttatgataatctcagtcctttttaatttgatatcaaaaatatttaatcttgctaattagactcacatgaacgataattgtcaccatgataacattttatcataaagaaaaggttttcacggcgctaaagtgatatttgtcacaaagtagcgttttacagcgagctacgacgtcaaatctaagtaggagggttattcatgcaggttatgttaacacattctctggtgtgaccagaacaacgttataaaaaggagacttaacaatgacgaatatatttaagggttggagaaaaaatgatactttttggatgctgagtttgttcggaaccgcgattggggccggcgtgttgttcttaccgattggggtaggtacggcaggtattcttggtattatcatgatacttattttggctttgccaaccacgttctttgctcacaggggcctgagtaggtttgtcctgtcggctaaaaatgatggtgatgacatcactgatgttgttgaacaacattttggttttaagattggattgctttttactattatttatttcttctccatttatccaatcttgttagtttattctgtttctattacgaatactgtatcgaaatttattactgaccaaatgcacatgcaaacaccacctcgttggttgttgtcacttgtacttgttgggatcctcattggaattgctcgctttggcacctctttgattaccaaagttatgagtggcctggccttcccatttattattgtaatcgttctgttttccttttatcttattccgcattggaatggcgcaatcctctcaacattttccagttctgtatctgggggacacttggttggaacgttaggaaacttgtggttacttattcctgtcatgatcttttcgtttaaccattcgccaatcatctcttcgttttccgttgccgaacgtaaagaatatagtggggaaggcaaggacagagtcgataaaaagatttcgacaattctattgtcggccgaaacgttgatggtcattgtcgcaatgttctttgttattagttgtacattggcgttgactccagaccaaatccttgaagctaagaatgaaaatgtctcgatccttgattacgttgcgactgctttcaataacccaattattaaatatgtttctcccgtaattgcctttattgcaatcgccaagtcctttttaggacattatctaggaacgagtgaaggcttacgtgggattattcgtaagatggaagaaaaatctgacaagacgcttccgagtcgaactgtttcgacaattgttgatctggttctgctactaagtgcctggatagttgcctggatcaatccttccattatgggaatgattgaaaccatcattggaccaatcattgcgttcatcttgttcttgatgccaatgtatgctattcataaaagtcctaagttacagcaatatgccggcaaacacagcaatgtctttgttgtggtcattggtttaatcgcagttagtggtatcctgttcaatatcatcaaattgtttgtttagtaatctgactgaaatacgagatgaattcacattggttaatatgattgaagccaatttttgtcataagtctcgttgctggtgttgttgacgagattctcgtgacggtgttgggggttcgtgagggtcacgaatcgaatggccatacttgaggctgaattaatcacagcggcggaattaattcagaaatgaaagctttgatgcaacggctgtatgctttctcatcagtacaactgtggtgcttgcttgtgccgtaacttcaagattcataaagtttcaaaaacggtgtactgacgatgaatgtgcaatgaagcgctagttgcccgtgccaaagcttaagttaacgtgatgattcaaataggaggatgactaaaatgacggtgaattacaagagtgtttttgatattattggcccgattatgattggaccatccagttcccatactgcgggggcgtgtgcgattgggcgagcagcgaatagcatttttcgggacaaaccgacagatattgtcattcattactatgaatcatttgcgcaaacccacaagggccacggcacggactatgcgattattagtggcattcttggctttgatcctgatgatagccgggttccgtatgccattggtttggcccgggatcaggggatgaacattacctttatcgaagagcctggcgatagcccaatcaaccacccgaacaccgccattattgacttgaagaatgatgataaacaagtgacggtcgctggatgttcaatcgggggcgggaccatcgaaattcgtgaaatcaagatggatggttttgatgttaaaccaaaagggccacttcctatcttgttagttcagggtggtgagaatgaccatcagcacgtgactaaacagttggctgacctgactaaagtaaacgaccaacagcagtacaagacggctcggggcaatttatatgaatatgatttagatcgccgtctcaaacaggatgaaatcaaaaaattagcgcagggtcacacgaatctagtttacttataaccagggaggtcagttatcatgtatatgagcgtagcagaactagtaacagcggccaagaaaaccaagaagccaatctacgaattaatgattgaacaagagatggaaacatcgcaaacgagtcgcgaagaaatctggcacacgatgggccggaatctagacgtcatggaagcggctgttaataagggggctgcaggcgacggggtctattcaacgactggtttaactggtggtgaagctgttcttttgaaaaagtatcgtcaaaaagggcacaccttatctggcgatacgatgatgcaagctgttcagaacgcgatttcaaccaatgaagttaatgcctcgatgggcgtcgtgtgtgcgacaccaacggccggatcgacggggacactacctggtgtgattttcacactgaaggaccgaatgaacctcaaccgtgaccagatgatccaattcctatttaccgctggcgcctttgggatggtcattgctaataatgctgggattgctggtgcgactggtggttgccaagctgaagttggtagtgcctctgcgatgggtgcggccgccgcggttgaagtggctggtgggacgcctgaacaaagtgccgaggctttggcgatggcaatcagtaacttgctggggttagtgtgtgatcccgttgctgggctagttgaattaccgtgtgttaaacggaatgcgattggggtcggtaatgcgttgattgcggcggacatggctctggctggctgcacgaacaaaatcccagcggatgaagtcattgcagcgatggataaagtcggtaagggcttgccaaaggcacttcgggaaactggattgggtggtttagcagcgacaccgaccggtcttcggatgaaggaaaagatttttggacgatcgaccgattcacaagttcatgcataaaagtgtcgcgaaaagatgatgagctgactaaaggcaatatcatcttttttgtttaaatgtttatatcgttacatgtattaacattttatcagtgtgataaaataatattaagtcataacgttgtaaaaaaatagtgaggtgagtgccgttatgcaaaaaccattaacagctgagcaagaatacgtgcgcgagtttattccgtttgttgattttttagcagatatcttaggccccagtagtgaagttgtcctgaacgacttgttggatttaaaccactccgttgtggcaattcgtaattcccacatatcacatcggcaagttggcgatcctgcaactgacttggcgttgcggacgatgaaggccggtaaaactgaaaagcgggattatcttgccaattacaaaggtgtttcgcaaggcaagcactcactacgatcatcaacttactttttacgattagatggtgaaatcgtcgggatgatctgtattaatacggatgatagtgccctagacgacctgcaggaacaagtgttgaaggtaatggcgagctacaaacatttgaactcaccaacgattcatcaacttaaaggaacaccagctaacgagaagacccatgacacgccggtcgcgccggaacatctaaccacctctatcaccgatttagctcgggaagtgacccaggcggtctgtgcaaagtatggcgtctctgtagaatacttaaagcaaaacgaaaaattagaaatcgttcgtagcttataccaccaaggctacttcctgctgaaggattcagttagcgaagccgccaaagtgctcaaagtctctgatccgagtgtttatcgttatttgcagaccgtcaaggatgaggatctccagcaggattgaacgatgcaattgtaagcgattaacggcatgaccctcgtcaaaatttagttcaagtcatagtgacggaactgtgagaaagctaatctgagttcccggacaggtagggatcatggtcaccaccgtaaaaatgcggcagccaacacaaccagtttgtgtgcgggctgccgcattttaagtagttaaataaactgagcaatcaaatcccccgttgttcagtggtggctggtcgcaattggtgtggcgattagtgccaggggagcgtgtgtttttatgtgattcaggttggaacgtagcccctttttatgatgatttggttagaatgacatctttgaggatgtcagtgggaattttctaggtcttatcaaaagggggattaaagattttattaatttggttatcaactgattattatcataataaatctcatgcaattttcattagctgacagcgagttgaaaggctgatgtagcgggggtcaattgcgattattatcaattatcaaagattatcaaatcgtatcatggaccgttgatcggcgcattatatggtattatggtgaataataaatggaggtgatgccaatgttgacaccgaacgaaattcgacaccggttacgacgcgatttggttacaattgccgaagcttatcagattggctttgagagccgtttatacacggaagccgagtatgaaaacttaaagcagacgttattgcagttgcgtgaacttaatatgaaacctcaacatatggaacagctacttgcgattaacgggtaacggaaggttattaattaaataaggaagtgattagtcatgaatactgatagtccatcaggttcaattcagtccagagagtgctaatgccagtgaaatttatcacgcgcattagcacttttctatttttctatcgggcgttgtgctaataatcgttctgggcggggcatgattaaagtggaacgtttaattgaattattattcggcatcatcgcgctcccaatcatcgtatggggtacatagtatgacagcagcaaaattagtgaggaatagtgacgataatcatgtgactatgttaactgttaatatcagaataaactgtgtgatatcggcgactttgacggcaccttaaattgcgcagatttagcttaattatcttaccaaatcattcatgaaagcgcttgaattagtcgagttgatgattttattgggtaaaaagattacagtttcctgatattggttgtatttttgacagacattctttattatggttaatgattgtatgatacagtgtgacacttatttagcgaggaaagttatgttatgaaaaaaatgataatccatggcggaaaacgactttctggggaattaacgatcggtggcgcaaaaaatagtaccgtcgcactgattcctgctgcgattcttgcagacactccggtccaattcgatacggttccgcacatcttagacgttcacaacttacggctcatcttagagtcgatgaacgtccattccacttttgaaaacgatgttctaacaattgatccaacaaatattgaagaatctgaattaccaagtcatgccattaaaagcttgcgggcttcttactactttatgggggccttactcggtcgttttaaccgtgcaacggtgactttccctggtggtgataatattggcccacgaccaattgatcagcatatcaaggggtttaaggcgctcggtgctaacgtcgttgaagagaatgactctgtctttatctcaacgggcacagagggccttcacggagcgcgtatctttttagacgtggtttccgttggggcgacgatcaatattattttggctgccgtcaaagcgcatggtacgacgacgattgaaaatgcggctaaagagcctgagatcattgatttagcgacctttttgaataatatgggcgctaaaattcggggtgctggtaccgacgtgattcgaatcgaaggcgttccggcactgcattcgcgggcaacccatacgattattcctgatcggattgagacgggaacgtatctatccctggctgcttcgattggggacggtattttgctaaagaatgtgatccctgaacatatggagtcattcacggcaaaactagtcgaaatgggtgttgatttacagattaatgaggatagtatttacgtcccacggtccaatgatttggacccaattcgggttaaaacgatgacttacccaggctttgccactgatttgcaacaaccaatcaccccgttattattacgcgctaacggtagtagtgtggtgattgatacgatttatccgcaacgcacgcaacacgttgaacagttgcgtaagatgggggcggacattcgcgttcaagataacttgattgtcgtgggtcattcttcccacttacaaggtgcgcatgtcgaggccggcgagattcggtctggggcggcgctaatgattgctggtctcgcagctagtggcgtgacggaaattagccgcgctgacaatattctacgtggctatgatcgggtcatcgataaattgcatacacttggtgcggatgtggaaattgcagctgacgaagaagttcccgaaaactaacgatgtacagctaagaaagaacagtggttatggaaaaaattttaacaatgcacgatctcgagcagaaaacgttaaaagaaatttataactatgctcgtgagtataaaatttcttattattcgcaaatgaataagaaggaactctcattagccgttctccgtgagcaggataaaaagcggggctttgtacaaatggaaggcgtcttggaaattattagccaagagggctatggctttttgcggccaattaattatgggccttcgcaggaagatatttatatttctcagtcgcagattcatcgctttggtcttcgtaacggagactatgtggctggtcaagcccggccaccgcgacctaacgaacggtattacggtttaatgcgggtagggacagttaacggtaaggatcctaatgaggccaagcaacggccccattttccagcgttaacaccactttatccacaaaaacaaattaagttatcgacaacggctgccgttttagcgacccgtttgattgatacttttgtcccgattggcttcggtcaacggggcttaattgtcgcacctcctaaagccggtaagacgacgctgttaaagaatattgcaaatggcatcgtcgccaattatccagacgctaagctgattatgttactgattgatgaacggcccgaagaagtgactgatttagagcggtcaatcaagggagaagtggtgagttctacttttgatcaacaaccacaaaatcacgtgcgtgttgcggaattagtgcttgaacgtgcgcggcgcttagttgaagacaaacaggatgtgattatcttattggattcgattacccggcttacgcgggcatataatttggtcatcccatctagcgggcggacgttgtctggtggggtcgatcccacggcgttttacaagcccaagcggttcttcggttccgcgcgcaatatcgaggaaggtggtagcctaacgattttaggcaccgcgttagtcgatacgggtagccggatggacgacatgatttatgaagaattcaaaggaactggcaactcagaattacagctatcccgcgagttagctgaacggcgggtcttcccggcgctagatttgaagcaatccagtacgcgtaaagaggaattgttggttagtcgtcagaatttggagccagtctggcagattcggcgatcaatgactggcaacgcgttagagtacaccgaacagctcttacaatttttaaaacacacgaagaccaacactgagtttgttcgtgatctagctagcttaaagttcactggacaatcaacccggcggccgcgtcgttaatactggcaggctactttgtaggttgacgggaagctgtgattcgtgataacatgtttatcgttggttaaaactatgataatctctgtttcagcaaatgattcagggcaaaggagcgaaatacaatgcaaaaaggaattcatccagattaccatttagttgtgttccaagactcaactactggttttaagttcatctctggttcaacagcaacttcagcagaaactgttgaatgggaagatggtaatacttacccattgatccgtgttgaaattacgtcagattcacatccattctacactggtaagcaaaagtttaccaaggccgatggtgcggtcgatcgtttcaacaagaaatacggtctcaaataagcagacaattaaacggcgttccggcttcggctggggcgtctttttttgtgaccatgctgctgctaagaattagggtgaaattggctcgggcgaatgataactataatataaaattgttattgaccaatcataaaaataattatattattaatacgaatggaagcgacaatactttttagaggacgacaaaatgaaagcgcttaaacttaaaatggttgccgtttgttaagtatcgtaacttttggagcagtcggcgcgaacactgcgctcgcttcgaatgacaattggggatttcactttagtattcaaccctaccaagccaatacgcggagtggggcacgctatcgtcaaaccactaatgtaaataataagtggaaagtgaatatgcagagttccgcagaaggggcccgtacggtcactacttactggttagagaatgcgggtgggaccaatgtatcaccatcgctaaacgtaaagcaaggcaatggttcgtattattcagcggcgtattcaaacgcgtcgaagaagaacgtgtatttaactgcacagaataataactataatagtagtcgctattctgtatctggtttctgggacgaggaaacgaattaaacatgcaataatatttttttgatatcaagactaatgcttccattcagttcacgggactagatgaagacatttagaactcgttagtaatagttcggcgttactggttaatgattgctttggtggtcattgtcactaacgccgatttgtttctcaagcgttaaatcaatagacttgttctagcctattggtattgcctgtcgtgaatatgttgacagcagcttgtgattgcagcagccattgtgctttgataggcgctgtcaattgatcaacatgcggaatgttgataggggaggatcagatgaagtattttaagacacgtttgatgatggataaacgctactggctcatgacactattcttcgtgattgtgattaatatagatttattactgatagttaaagaaagggaacctttttcgggccagtttttgacgtttttagcagggagttcattggggcactatccacaaatggcactgttgtggttgctaccagcatacttactacttggccccggtcgatggtatttacaagatgttaaggttggtcagattaatctactcataacacggatgcgaaagcctcagtacttgcaacaattattacgaacgtcctttattagtgttgcggccagtgccttatttgcgctgctgttaaattatggattagcattgttgctttttcaaaatggtagcggtaacagttatcggatgagtgattatcaagatggctctgacccattcttatattggcaattgctacatccagtattggctaacttactcacaattttgttaacagcgatgatcttagggttgtttgcgatggcaattatcgcattgagttttatgttcaagaaaattagttatgtttttggcctgagcatggtggcgtggtttattccgatttctacgaattattccattttaagcgttctccaacctttccaagagacaacgttaacggcacagctgatgatactgctcgtgtacgtcatcgttttattaggcgttatctgtgttggttatgggactgaggtgcatcgggatgagctttgaacggagcgagaagcgatatgggtcgtacttgataattattatattttttatgtgtacatggttcataaaaggactgcagttattaataaacgccgatacgttagggatgtatttgcttgagacgaataaatccgcctttaattattttgataatttaacgtttgcctttatgtatttgccgctatatttgctgttcgagtatatgttgtggcatgagaattctcagattgtggttcgctttggctcccgagtccgttatttacgcgcacagacaactggtctgattaggagtaccttgctgttttgggtggttttcgcgttcttcggcgtattgccgttaatttcgttaccaggatcaggttggggaacatttatttatctctttgtggttcaaacgctagcgtatttcttgattagtttggaatttggaattgtgttgttttggttctttcagttactccctaaattgcatttagtgctattcttgtcgctcgcggtacttcctatcatttattatggtttaccaatcaggccgatgttccaagaagttgacttgctcaaacgatattattatatgcaggatttaacggcattaccgatgtcggctttaattacacttgttgccgtgccgattatgacactgtgcttgcgagtgttgtggattcagcatgaggagttttggcaatgaaaagacgacttcaatacagcgtgttactgttgattgcgttagtaccggtggtgtattacgcacatttttttgaaggaatccaccccggtacggtttatttctataccgatggtttaccaccgctcgcgaatccctacttggtgcgcatttggtttttcccaattattgccttactggccgtgaattttaatttcgtgcatcatcagttgcacgggccgtttatccaaacagttgtcagaactcagacgcgttgccagctttttggccgtttgtatataactaaaatcgggcatcaaatgggcgctttaatgggtggattggttgtttatttactgtgccgaataatttctggctatgccgtatggtggcctaactgggcacacatggggctttcgttattagcatttttactgctattttctattcaatttgtgggtgacttgtatgttgaaccgttgattgtttacattgttcttaatgtatacgtctttgtcagtctttccataccagccgttgacatgaacggtgtgatggggctggtactgtttccgaacgcgctaatggcctgccgagtacagcatgttggcctttattatgttggtttgctggtcatggtgctactatttatcttaattggaaggtacagattcaatcgaatggatctgttataggtgattacgatgattgaattgaacgatgtgactaagtcattggatgggcacttggttttggaccatatcagtcgaacattcatggatgggcgaatctatgggttgcgcggtaagaatggtgcggggaagacgatgctgctacgcgccattgccggattaattaacattgagtccgggaaaattatgattaatggcacacagttacacgatgggatggactttccacctagcctagggattttgattgaaaataataacttaatgccagaatacacggcacgtaaaaacttgcaactgttggctaaaattaaaaaagtcgcgagtgatgctgacatcgatgcaaccattacgcgagttgggttggatccagatgacaagcgaacggtcaagcagttctccttggggatgcggcaacgcttggcaatcgcgcaggcgatctttgaacggccagctttgattttactagatgaaccaaccaatgcaattgatacggatggggtcaagcaagttcggacaatcctgcttgaagaaaaagcccgtggcgcaactattatcattgctagtcacacggctgaggatctggtcgtgttggcggatgaaatctatgatatggctgaggggaaaatctatgaatcagcagacgcgcaagactagatatttatttattgggattttttcaatcctatgtgtgattctaatcggggtgatgatccataagtaccgggtcgcgcacagcgatattcgcttacattctacgaagacgaatactgctaaaactttccgatactcagtccaaaaagagatggcggcagatcaggctggtcaggattttaaaccagggtattatgacgtccacgtgactaatggcaaggtatacgtgagtggctttctcggtagcggccaaacgattcagaacatgctgtatgtcagtggcaatcatcttaactttacggggcatggcgagaccgagttgaccccgtctcgctttaagccgttgcagtttaagtcacgacgggcggtacttgagaatacctttggtaattatacggctggtcgtgaaattccggccggtaagtatcaaatctcctggtcaacgccggcaaagcgccaggcgaacttggtcattagtattcaaaaaggtacaaaggttcagcgctcgattgatctgagggctggcaaactggtaacgtttaagttggctaaggcggaggtgttaaccattaacccgccagtaacgaacgacgtggtgccacttcgaatcaccatcacgaagtagtcatggactgaggtagcgaaggcttgattagcagaaagcccaagttagttgcttggtttaacacaaagtgaatggtaagtactgaattgattaataggcgcttgccataataaatcagcccaccttagttcattgagcaaactgaggtgggctgatttaggatattaccggttggattagtagcgcataatcgcgagagcagcggtttctacgggcatccggtctgcggggatgattcggatttgcccgttcatggcaatcacgacatcgaccaggtcgtcaattaaattatcaggagcggcaattggatcagttaattgaacatcggccgttggtaaggagccggcgacattcgcgtctgcggcgacaatcaaggtgtcgatccgcccacttagtgctggcttgatcatgtcaaaaggatcggccaatgctaactggcgggacttagcctgatcataacgttctagtaaaatgtcggctaattgggtatgccacatcgtctgaacgggttctgtggctgtttgcattgcgcccaccgttaagtttttcggtgacttattgatcatgaggtgttgtgacaggtacggattcttgttgacggcacggaagactgcctggttatgtggtagtcccattaagatcaatggccgtcgcgtcttttgtgaatgggcctgaacgtactgcgccacttgttggtaataatttcgttggtcaatatcgcgttcttcggctttcgcattatgaccatgatagttggcaccgtgaacggggctggcgttgaaattcaggtcaccgccacgtttttcagtgcccaatgcttctgtcagggtgcggggggcctcagctggcaaatcaagttcggcgaaactgccatcacgttgggcgtagagcgccatgctatcttcgttgagtgctaacaagtcgaagtcgaattgatgctggcggtcggctagtactgggcgaatagctggcatgctattgacgctgacatgattgtcagtgggatattgtaagtcgaaaatgtgtagatcacgactgttagtgatgatacccgtctgagggccagtgtgctgtagccagaaggcgttgtcattaattaattgctctagttgcgtcgcgtatggcgcaaattcggttttcggaaagtggtgggccatctgggtttcagcttcattaactaattgtttgaattgtaagcggcggcgattgaggtcgttgagcacaacggccgtgttgaggtaaattgcaatgtatgggccatcctcacgttgttgcattagttgattgagatcgttttttaccatcgtttccataggtccaacctgctttctgtttttgatacaattagcataacaagaatctgattacggatgcaaatataatgattatgataagctagagataattctaacgaactaaacgaattcggggctttattatgcgaactaattaaggtatatttaccgtagaacctttgatgaagggcgtaaacaaattaggaggcgggattaatgaagtccaagcaacatcccgggttaaagtggttaggtcggggcgtttttgtcctgctggtgctagtatcattggcattaattttcaatgaacagatcaagagctggctagtgagttcatactcgccgaccgttacggctaagacggttaagcagaatacgaagaagaagagcgattttaacttctcaaaggtcaagtcgcttgactttcagaccgttgccaaggcccgcatgaataagaatgcaatcaacgtgattggctcgattgcgattccgtccgttgatttgtacctgccaatcggtaatggtgtcagcaatgaaacgttagcattagcggccggcacgatgaaagctaaccagaagatggggcagggtaactacgcgttggctggtcaccatatgatcaagcatggggcactattcagtccgctgtactataagagcaaggttggccaaatgatttatgtgagtgatgccaagaagatttatgcgtataagacgagtcagcgaacattcattaaagcaactgatgtccaagtaattgatgatgttcctggtcagaagctgattaccctaattacctgtgataagaccggggctggtcgattaatgattcgcggtaagtacgaacagcaatggtcgtttaagtcggcgccaactcaggttcagaaggcctttacaagtcattttaataacaaatattaacaattattacattctaggggtatcgatatcttctaacggaatttcacggtacaatataacttaaggtcacatgtctcagataagacataatttagagggggtctattgatgatagctttaattatcgttgcggtcgtattggttttgatcgcaatttacgtggtaatttataacggtttagttaagtcacggatgtatacgcaggaagcatggagccaaatcgatgttcagctaaaacggcggactgatttgattcctaatctggtcaatacggtcaaaggttacgcgaagcatgaaaagagtaccttggcggaagtagtttcgttacgaaatcaattagcgcaagtgccaagcggtgatcaccaacaggcgatggcagtttctgatcaattgacgaattcattgaagagcatttttgcgttagctgaaagctaccctgatttgaaggccaatcaagaattcggtaagttgatggaagagttgaccaatacagaaaacaagattgcttattcacggcaactgtttaactctagcgctgccagctataacatgaagttacaacaattcccgtcaaacattattgctggcattcatcacttcaagaacgttgaattcttaactgttcctgaagcagaaaaagcagcacccacggtttcatttgaagattagaggttatgcccatgttatttgagcaaattgcccgcaacaagcggcacacgttatacgtgatggccgcttttgtcatattacttgcagtgattggtttagcagttggctacgtgttctttaatagtgcgattgcgggactactagtagctttgattgcagcggcattttatatggtattaatgattagtcagtcgaccgacattgtcatgaacatgaatcacgggcgtgaactacatcaagctgacgatgatcccgagctctggcacattgtggaagacatggcgttggttgctaaagtaccgatgccgcgcgtcttcattattgatgatgagagtcccaatgcgtttgcgacggggaatgaccctaagcatgcggcagttgcagtgacaactggtattcaggcacgattaacgcgtgaagagatggaaggcgttattggtcacgagatgagtcatgtgcgtaactatgatattcgactacagactattgccttggctttgacagcggctatcagtttgttagtcaattgggggatgaacgccttttggtggggcggtggtcggcgcagtcgggatgatgatcgtgacggcaacggtgcccaggtcttattaatgatcctagcgattgttgtcattattttggcgccgctagcagctagtttagtgcagatggcgctatcccgtaatcgcgaatacttagcggatgccggcagtgtggaactgactcgtaatccgctggggctgatcagtgcacttgaaaaaatcgatgacagccaaccgatgcaagcggcggatcctagcagcgcggccctgtatatttctgatccgtttaaggcgaagaaatcatggacacacttattcgatacgcacccaccgatggctgatcgcatcactcgtttaaaaaacatgtaataaaaaaatgcgtttaggttaataacggattataatgaaaacaaatagaaagttgaaagagtgagacggttgcaacgcaaatatatttacgccaatttggaaaaactggataaccttgtctttgcttacgggatcgaccagagcgactttgtgcatggtatcaaacgcttgccagctaacttggtctcgttagtcggtgttgatgataacgagcatgcggtaaatgctcacacgggtctgaacgtcattaatgatgaaaatgaaattcggcgatatttgttacagagtcacgcgttacccgttaagtggcttgattatgatgaagttggcgatttggattttctaaccgcgactgagattgccgagctattgtatctcggacatatggatcgtccaattcgatcaccgtttaattacaaactgcgcaaccactacgttttcttggaacaacgcaatggtggtatcaaagtgtacttctattatatttccgcatttagccatattttaagtgctgccattgtgcgccacactttggcagcttaccgtggccggcgtatgtttatgcgttcactgagtgttccacgagtacctgaagcgattctcaagcaactcgttcaattgatgccagatggtttgttcatttactttgatcagtcaatggttcggcaacgccaattattggtgccggtgcacacggagacgacaggcaatgaaatcgaagtttttgatcccgctcgtggtggagagaatcggcgaacccaccatgtcgcgacccttacttttaacttgaattcaggcgtgtgggacttgcaagtgcaggaccaggctgcgttcgaagaacatttatagtattatcatcttaacgcttggctgatcattcagcgggcgtttttaagtcgtttggggcgggatttaggggctaaattggtctagccatagagtccctggggtcaaagtggtataatttttatgcgcgtagcttgaattgggctacgattcgagaaagtggaaccttagtcagaacttggctgaccgacaagtggtcgccatgaatggagagtttaatcgatatgaagatgcaagttgccgaaattgctaaggccgttcaagcggtcaatgccgaacaggcgtggcccgatgttaatgtaacgggtgtggcgtttgatagccgaaagctccaagcaggggatctatttattccgctgatgggcgctaatgatggtcatcaatatattcaaagtgcaatcgagcacggggccgttgctaccttatgggccagcgaccatgccgacgacgttccagaagacttacccgtcattatggttgctgatacattgacggcactacagcagctggggcaatactatttacaaaaaatcaatccgaaggtcgtcgctgtcacgggtagtaatggtaaaacgacgacgaaggatatgattgcgagtgttttgagcactcagtttaacgtgacaaagacgcacgccaactttaacaatcagattggtgtgccagtgacgttactcagtatggaaccgaatacagaagtggtcgtcgttgaaatggggatggaccattttggcgagttggatttcttgagccgtctcgttcagccggacgttgcggtgattaccatgattggggaagcccacattgagttctttggtacacgggatcgaattgccgatgccaaaatggaaattgtccacggcttaaaagaagatggcacgttcatttttaatggtgatgaaccactgctacaagaacgtgctaaggaagtcagtcagcatcaacggacgtttgggttggatgatacgaacaccttagcaggcagtgatatcacgactagtcgggctcaaacgcaatttaagacgagtctgtggccggacaacacgtacacaattccgatgatgggtgcgtacaatgtcaataatgcattggcggcgctcttggtagctgatacttttcacattcgaccagccgctgcgcaacaagcaatcgccagttttgtgccgacggagaaccggacggaatggttaactggttaccgtggagaagctatcttaagtgatgtttataactctaatccaacggccgctcgacgggtcttagccgcttttgcggcggtacctactaagggccagcgaatcgttgtactcggtgatatgcttgagttaggtgaccagtcggatgcactacacatgagtttagccagtgaattggatccagccacgattgccagcgtctatttgaatggtgagcatatgcgagcgttggcagaagtgctacaagaaaagtaccccgccggtgcggttcactactatcaaacagatcagcaaccccaattgattgctgacttaaccgcggcagttggtgcggacgatcagatcttattgaaggggagtcacgggattcatcttgaaaaagttctgacggcactagaagctgctcctgaaaaataaaatttaagtgatttgattaataaggcccctcgcaatgactgggtaatggtgacgctaacattagcttaataatgttgtttcccttccagtattgccaggggccttgcttgcttatttagaataaccggtgtatgataattcagttgtaccatatgaaagtcagaccgttggcttacatgacagcgtcttacgggaaacggattttttcctagctggcagtaatcccatggtgtcatccttaggaggaaacatatttgaagtttacagaactaggcttatccgatagcctacttaaagcagttaatcgggccggatacgaagaagcgaccccgattcaagccgaaaccattccaatggttttagaaggcaaagatgtgattggccaagcacaaaccggtactgggaagaccgccgcgtttgcattaccaatcttacaacgcttggattttgacaaccataacattcaagcattagttgtttcaccaacgcgtgaattagcaattcaaactcaggaagaaatcttccgcttaggtaaagacgaacgggcgaaagtccaagtcgtttacggtggtgctgatattcggcgccaaatcagaaatctgaagcaaaacccgcaagtaatcgtcggaactcccggccggttgcttgaccacattcgtcggggcacggtcaagttagaccacgtcaagatgttagttcttgatgaagctgacgaaatgttgaacatgggtttcttggaagatatcgaatcaattatcaaacaagtgccggatgaacgccaaaccatgttgttctccgcaacgatgccacctgaaatcaaacgcattggtgtgcagttcatgaaggaaccgcatcacgttaagatcaaatcaaaagaaatgactgctgatacggtcgatcaatattacgttaaagccaaagaatttgaaaaattcgatattatgacccgattgtttgatgttcaggcacctgaactcacaatcgtgtttggtcggacgaaacgtcgggttgacgaattatcaaagggtctcgaagcgcgtggttataacgctgctggaatccatggtgatctgagccaacaacgtcggacgcaaatcatgcgtcaattcaaggctggcaagttggatattctggttgcaaccgatgtggctgcccggggacttgatgtttctggtgtgacccacgtttacaattacgatattccacaggatccggacagttatgttcaccggattggccgtactggccgtgccggacacaagggtgtttcattaacttttgtaacaccaaacgaaatggaatatttgcgggtcatcgaaaagttgaccaagaagcggatgttaccattgaagccaccaactgaatctgaagcttttgctggccaactagctgccgcagaagccaatgttgattcattagttgccaagacttcaactgaaaagtatgctgatcaggctgctgaattattacaaaaatacgatgctactgatctagttgctgccttgttaaatgacttaactaaggacgacgcttcagccgtacccgttaagattacgccagaacgcccattacctcgtcacaaaggtggcggcggtaacaaccggcgtggcggatatcgtggcggcaatcgcagccgcaataacagtcacggcaatggccgtggtggctattctcacaatggtcgcaatcgcgaccgtgatcgtaacggtggccgtggcgatcggaagagcaatggttataaaggtcgcagccgcgatgataaccggagcaacaaccgcaaccatgacgaaggtcgcaagcaaagcagcaagcggagctacacgatccgcaccaatgattaaagtcaacgcacaaattaagttgaattaaattaactttgcatcaaaagccgagcgcacgctcggctttttttataccctccaatgctaaaatacaagtagtcgccagacattcgaatgaattattgttaaaacgtgccaaacttggcaagtcaaagtcggccagcttatgcccgctggaaacggttcggattagtgtaaacctgcttggttagttcgtcctacgccgacctccaggcatttctgccaattgccggaacgtggtgggcacagatttaagccgaagcccacgtcttaaatactggtcttccactaaccaagcaaaggacgcttgctaagtgaaatttcaccactgggcattgtcagaaacgccttccagtcgggatagtattcgaatggcggacggagatgtacccaacttttgataaattgttgttttttataaacggtaattttgctaagcaactatcagactgaaaatgatattggaatagctcactatcttaagccgctgtagtcaaaattgaatgttgcgacaaagtagtttatgcaccctgatgttttattcaaagtccccgtaccaaaatagtcagcgaccaattgtaccaagttaagtggccgttcatccgccatttgagcggcttaccgaaacgtgctcggtgccactgaagcctgtgcttgctacgccaacggactaatgccaaaaccgcattaatccgttggctaggcaatgctcggcttcagcccgtggcccctcacactcttgagaccggaggggctgggtgacaatgctcagtagccaaattattcttagtcggaagtgattttcttccggcttagaataagactcgtatttgagaccgggcgggctgtgcacgggctcaaatcgatgtcggcttacgttccagcaattgtcacccagccctggaggtcggcataggacgcacaagtgctgacgaacaacaagccaagtaaactggcacgttttgacaataattcatgctgacatgaaaagattgcgtgtatgggcccttttatcgaggcggtagctgtggtaaattggaaacatcaacctaagctaacatggtatgagatagaggggtgagcggcgtgatatatggtactggcattgatttaactgagctgagtcgaattgaagcgattctagcgaagggattgcgattgcctgagaaggtcttaacaccagcggaattggcggtgttttcgcgttacccggttaaacgccagattgagtttatggctgggcgtttttcagctaaggaagcatatagtaaggcgtatggcacgggaattggtgcggcggttggatttcaagatatcgaaattttagataacgcccagggtaaaccggaagttacgcgtcacccgtttgacggtcccgcgtggatttcgatttcacacacggatacattagtaatgacacaagttatattggaaagaggcaatttgtgatggttgtaattggggagcaccgccacacacaagtcacagtcgacttgcaggcaattaagacgaatatcagtaatgaaatggcacagaaagatgagttgactgagttatgggcagttgttaaggcgaatggttatggacacgggattattcaagttgcccaggctgctaaggaagctggggcgaccggcttttgtgttgcaattttagatgaggccttagcgttgcgggccgctggttttgctgaaccaatcttagtacttggaatcacggaaccagaatacgcgccattggtagctgaaaaggatatctcactagccgttggaacgcaggattggttgacaacggctgccgcaattttagcggctaatcaagtgacgaccccacttcacgttcatcttgcattggatacggggatgggccgaatcgggttccagacgcccgaagaattggcaacagcggttacgactttgcgccaaccgcagtcaccatttgattttgaagggatctttacgcattttgcgacggctgaccaggcagatgatacgtattttacccaccaattaaataattggaaacacttgattgcagtggtggatgagctaccacgctatgttcacgtgtctaattcggccaccagtctctggcatcaagcttgtaatggcaacatggtgcgcttcggggttgcactctatggcctgaatccttctggccgcgaactcagcgcgccgtaccccttgcaaccggcgttgtcgctaacggcacgcttgacgtttgttaaacgcctggctcggggcaaatcagtcagctatggcgctacctataccgctgctcaggatgaatggatcggcacggtaccgattggttatgcggacggctatgaacgtcgattgcaaggcttccatgtacttgttgatggtgagttttgcgaaatcgtcggacgggtctgcatggatcaattgatggtgcggctaccacacgaagtctcggtgggaactaaggttaccttagtcggcacggacggtgatcgtaccatttcgctccaagatgtggcggactattgtgggacaatccattatgagattgcttgtgggctggcaccacgtgttccgcgcgtttatgtggactaattgtccgtaagttggttggtacgatgctgacgaccggatagtatcgaagtgagtgatggcatcgtcgataataattacgctaattttaaaagagtactggaagaaattctggtactcttttcgagttggactagtgattcctgacgccggtccttggtggggatagtgtatgcgtgcgccccaattgataggcggttttgctgtggatgtggcgacccgattttctgggccggaagtattagttttagcggtgcttagtgattagttctttggattaaattggtaaacggttgctaaaagtgaatggttcatgctattatgagtagcaagatggttatattggggtactatcagatacattgggtatcgaataaagggagatgaggcgatggccgcagctgacattaagcgtggtgacatcttttacgcagatttatcaccagtcgtaggctccgaacagggaggtatgcgtccggtactgatcgtgcagaataatgtcggtaaccattacagtcccacagtgattgtcgcggcaatcactgctaaggttcaaaaagcgaagatgccaacacacgttaacatcaacgctgcccatacggggattgaaaaaaattcggttgtgttgttagagcaaatacgaacgatcgataagcaacgacttaaagatcgcgtcacccatttggatgatcagacgatgcgccgagttgacaatgcgttacaaataagtatcggattagctgatcgaacacgacgtcggccacaacgcacgttccaatcatagtcaatcgatggggattaattatttacataattgaactatttcggtgcgatgaccgagtacggataatcagcgggttccaattcagataataactgaattggggcccgcttttagtttctgatccagcggtcagtaattgatgcgcgctatacgaagccatttatcggtgaacttactttaatgtgcattatgattgtctttctggtggcgattcggtaagctaattgaacccattatacgggtacgatcgggtgtgaatttggaatgtcggcgaaaggatgggggcataatgagcaaacaggcgcagttcaataagcatcgcgcggcggggctgttagtcgcaatgggtgtggtatatggtgatatcggaaccagtccgttatacgtgatgaaagccatcattactggccagggcgggatgtaggccgttgatgagaaatttatgttaggggccgtttcgctagtcttttggacgatgacgttgctcacgaccgttaagtacgttctgattgcgttaaatgcagataatcatggtgaaggcggaattttctcattattcgcattagtgcgtcaccgtgcgcgttggctagtcattccagccatgattggcggggccgcattgctggcggatggggcgctgacccccgcagtgacggttacgaccgccattgaaggcttacgcgatgttcctgcatacgtcgatctattcggtgccagtcaaaccacgattatcctgattacacttggaatcatcacgcttctatttatgctacaacgttttgggactaacacgattggcaagttattcggtcccatcatgttgggctggtttacgtttctgggagtcagtggcttcgttaatttggcacaggattggacgatcttgcgtgccctgaatccatactatgcgtggtaactcttgatcagcccggcgaacaaagtgggtattttgattctagggagcgtctttctggcaacaacgggtgccgaggcgctgtacagtgatcttgggcacatcggcaaaacgaatattcgattgagctggccgtatgtcaaagtatgtttactactcagttatttcggtcaggctgcgtggattttaggacccggtcaagcggctcagagccacgttaatcccttttttgcgatgctacctgctagtttaacgatggcggcggtgatttttgcaacgctcgcagccatcatcgcgtcacagtcgctgattagtgggtcgtttacgttagtcagtgaagcgattcgactgaaattattcccccgattactgactacttatcccggtaaagcagtgggccaaatgtatctaccggtcgttaactgggggttgtggggcgtgacgagtatgctggtgattttctttcaaactagtgaaagaatggaagccgcgtacgggttagccatcacactgacaatgttgatgacgaccactttgatctacgcatttttacggcaaaagcacttaccgttgattggtgcgggactactgaccgatttctttgcaatcatcgaagtaattttcttgattgccagtgcggccaagttctggcacggcggctacgtagcggtcggacttgctttactaattttcctagtgatgactgtgtggtatcgaggcgaacagattgtcagacaacataatcatccgcttagtttacgacaatatcaggaccagcttgctaagttacgcgacgatcagacggtggacaagttccagacgaacgtggtcttcctaacgagccgaatggatggcgaccaagtggagcgaaaggtgttatattcgattttagacaagtggccgaaacgtgccgacgtctactggtttgttaatgtgacaatcacggatgaaccgtataccgctgaatatacggtcgacacgttagcaacggactacttggggaccgttaagttataccttggatttcgcgtccgccaagatattaaccgctatttacggacgattgttcgcgacttaatggccacaggacgtttggcgccacagaagcagacgtattccgtcacttctggtcgcgatgtcggtgacttccgcttcgtcatcatcgaggagaagttagaaaatggtagtcggttatcccgcttggatcgattagtgatcgagacgaaattaatgattaaaaaatacgcgacgacacctgccaaatggtttggtttagaattttcggaggtgaccctcgaaaccgtcccaatcctattcaacgagattccggcgttaccgattactgaaagacggtaatgccatgcggatttctgggggcagaatcagctagttgaggcttgctgaaagaagttcggattagtgtaaacatgtatggcttgtgtcacctgccgacaactaattgtaaggcgcttcacgtcggcgaccttctagcaattggcaaccagccccgcaatccggaataggacgaacaagtgctcataaatagaaatcgaactagccgcatgcttaacaatatctgagcgactcatctaattttaattttcaatggagcaactgataactcaaaactaattgcaatagctgaaattggacacaaaacgttgatttggcaacgataaaagaacagctgaattcaaatcaaaaactggaagcattaaaatttgtgttgacaagtgtgaacttagaactataatctaattatattctaattattcaaatgtggtgatgggataagtaaatcaatcgtgggtttttagagagccgggtcaggtgcaagccggtattcccacatggtcgaaaatggtctcggagcattcagtgccgaatgattaagcgctgacggtggtccccgataaacggacaagggtatctcaattcagtgagattgacgtacctgctgagaactattttgcgagaaatagtcgaattaaaggtggtaacacgagtaatcgtccttctgtcataacgacagtggggcgattttttattatatttttttgggaggcttcgcatatgcgaaaaaagggaattatttttgggttattgagtttcattgcactggggacggtgctagctggctgcggcagtagtagcgctagtagcaagggcacatctaagacttataagtatggcgaagtgacaataccagcgaaggacggttctatctgtaatgcgccaaattatatcgcgtatgagaagggcttctttaagaaaaacggactcaaggccaaactagtagctaacccacgggatatcagtgacctcgaagcgggttttgcgagtggtaaatatgacgcgcaaaatggtgactttcaatacttacctgcgattcaaaatggggcgcagatcaaagctgtgggtggcatccaccaaggctgtatcaagttactggttccgaaaaactcgagcattaagagtgtgaaggacttgaaaggcaagacgattgggattccggctcaaggttcaacaccccaatacgtgacgtccattgcacttcaacatgcgggcattgatccaaagacgggggtaacgtggaaagtttatagcactgacctattagcaaaggccgctgaaaagggtcaggttgatgcgattgggaccgttgatccatatgcttaccaagcgcaaaagcaatctgggtttaagaccattattgacaataataacaatagtggtaacgccaagatggctgcaatgggaatgaaatccaagggtgcatgctgctacctgtacgtatcgagcaagttagtcaaggagaatccagccaaggctaaagccatcgtccgttcatacaagcaagctgctgcttggatcaataagcatcctgaagagaccgcaaagattgaattgaataaagggtatgtctccaagacgaagtttatcaatgtgaagaatgtgactcaaatcttgaaggatgaacactttgaattgaatcttaagactggtaaagaagatttaagttactatattaagcaactgaagcaggctgggtatttgaagaagaatacgaataacaagcaattattgaagcaagcttattggtatcctgatttatctaagaactaaattcaaggaggcagaacagcatgcaaataacagcagtccaactgagtcgaaaaaaggctgcgcaggcagctaagacaaccggccgttactggaaaccctggcgcctgacctggaacatcgttagtttagtcgtattagcaattgcatattttgagaatcaattgatcacatcgcgggaaaccgttaataatcagatgtatcactggtttttgggcgggtactttatctatttattgatcgttacgctcgttggcacggtcacaaatggccggattcgccgatataatgggcattttgcccagttgaacgtctcgttaggtggtttgttgatcgtgcaggacctactgactgagaaatttgccgtcctagaacagccttttttcgtgagctttgcccagattttggaccagatgcgcgaaaatgccgccttgctctgggcctcgacgttgtcgtccttagcactgtggttgatcagttttgtgattgggaccgtcctcggaattttacttggcttgggtatggggcgctatcgtgagtttaactactgggccttcccctacttgaaggttatcggaattatcccggcggctgcctggatgccgctgacgatggtcatctttccaactagttatatggccgaagtcttcttgattgccttctcggtctggtttccagtggccttcatgacgattggtggtgttcaaggaatcaacaaggaatactttgaatcagcaaagaccttgggatttagtgagtggcagatcgttcgcaaaatcgttcttcccggggcgttgccaagtatctttactggtgtttatacagcgatgggattgtcgtttacaatgctggtaatttccgagatgattggtgctaaggtcggactgggctggtttatcaactgggcgaagggtaccgggaattatacgcaagtctatgcggcaatcgtgattatggcgattctattttcagtgttatttgcggtgtttaccaaaattcaagattactgcctacgctggcgtgatagcgcccactagaaaggagcttataagatgggattacttgcagttcaacatgttaatcagcggcttcaagacaatcatggtcaccagatcgacgtgctagatgatattgatttcaccgtcaatccaggtgagttcgtagcaatcattggaccgtctggttgtggtaagaccacgttactacgcctgatttctgggttagaccatcccgctagcggtcagttaacgatcgatgatcagcagattaaacaaccagataattctcgcggttatgtctttcaacatggcagtcttttcccgtgggcaacaatcaaggagaatattagtgtcggcctgaaagtgacgcgtgggcggcattatgaccacgaattggtcgaccactatattgaattgatggggctaaaaggctttgaaaatgcttatccgcatcaggtttctggtgggatggcccaacgagcggccctcgcgcggtcaattatcatgaacccgcagctcctgcttttggatgagccgatgggggcccttgatgcgtttacacgtgcggatattcaaaatgtcatcgagcgggtttggcaacagactcggacgacgatgattctagttactcatgacatcgatgaggcggtttatttgagtgaccgaattattgtgatgacgcctcggccgggaagaatcaaagaaattgtgacgaatccattaccacatccacggtcacgggtgagcgccgattttgccgattttcggcatcagattcaggataaattaaactttggcgctcgtgacgaacaggctgccaggtaacgactaaaaaatgcttattaagacgagtggcgagatgccagtcttgataagcattttttgctgtgaacacataggaccgcatggtgtgagctggatacggctgtctaggtaatcttgtcagttggactaattgcgagatggtaagcttattcggttaccatcgttgtcgcgttggccaacagggtcttgagcgtgtcaatcgccgtaattagtggttgcccatggttcaatgcagcaattgccacgggattatccggttggtcgttaagtgtgaaacccactgctttagtcgtggcgggccaatcagccgtgttagtcatcgtggtgacagtgaggtgattagccgcgaacagttcctgagccgcgggttgcgccaaagttgccgcgtcggtgatgagaccatccgtggtttgccaagtctctaagtggtaactatcagccatggcggcacgccaagcggtcgtaaacgtcgggccgataccgagcgtctcaccagttgatttcatctcaggacttaaaacgactggtgattgtggcaatttattgaaggagaagactggggctttaatggcaacttgctgtggtgtgggggtcaagagcccgggcactaggccaaggcttgcgatactttgaccgagaattagttgagttgccagttgtgccagtggcaagtgagtaaccttgctcatgtaaggaactgttcgacttgcccgcggattaacgtcgattacgtagacatcatcggtgacgacgaactgaatgttcatcataccgacacagtggaggtgttgtgctaatttggtggcaatggtgacgatcttatcttgaacagcagggctgaggtgttgtggcggatagattgtaatggaatcgcccgaatgaacgcccgcaccttcaatatgttccatgattcctggaatgaagcacgacgttccgtcggagagaacgtcaacttcacactcggttcccgccaagtattgatccatcaagataggcacaccatggccagctgccaccgctgatttaataactggcgtgagctcatgatcgttatgaacgattgccatggcccggccgccgagtacaaagcttggccgtacgagtaaggggtaaccgattgcgtgggctgcttgacgggcaccggataattcagtcacagttgtcccggcggcttgggcaatctttagctgatgcaaacagtccgcaaaagattgccggtcttcggtcaaatcggtggcagatacactagttcctaagacggtgacccctaattcagtaagttgatgggcgagattaatcgcagtttggcccccaaattggacgatgacgcccactggttgctccagcgcaataattggcattaagcgttcgatggtcagtggctcgaaatagagcttatccgaggtcgaaaagtcggtggagaccgtttcgggattgttattgacgacgatcgcatggtagccagcttgttggatggctttgacacagtgaacggtagtgtagtcgaattcgataccctgtccaattcgaatggggccagagccaagcactaaaatactgtgtcctagtgggtggctctcgttagtttgcccaaaagcagtgctataaaaatatggtgtgacactggtgaattcacctgcacacgtatcgaccattttgtaaacgaacggtaaatcagcggtcatagtcgcaatggtcgttaccgaagattgtgcatagtgcgccatggtcgccagactcacgccgtactttttcgccgttaagaggtgttggggcgtcggtatttgcttgatatcttggatgagttgggcgatgtgctgtaacttactcaagaaaaatggcgtgatttgcgttagcgtcgctaattttgctaacggccaacccgcttgcagcgccgccaatagatagaagagccgctgatctgtcgggtgggtcaattggtcgatatattcagtcgtggtgacgtggtggtcaggggtcaaggacgcttgggtcttgggatcgatttcaagcgaagcaatcgccttgagcgtggcttcctccaaggttgacccaatcgccatgacttcccccgtggctttcatctgtgttcccaagtgagcgtcggccgttggaaacttgtcaaacgcaaaccgggggattttggcaaccacatagtctaaagctggttcaaaggccgcataggttgtctgcgtgactggattcttgatctcagataaatttagaccaattgcaatatcggctgcaattttggcaattggatatcccgtcgctttagaagctagcgccgatgaacgactgacccgcgggttcacttcgatgacgtagtactgacgactattcgggtcttgagcgagttgaacgttgcacccacctctaatgtcgagggcttccacaatcgtcaaagccgccgttcgtagctgctgatattcagtgtcagtcaaagtctgaacgggggcatacacgatagaatcgccagtgtgaataccgaccggatcgaagttttccatggaacagacgatgatcttggtaccctgattatcacgcatgacttcgaattcaatttctttgaagccggcgatactttgttcaatcaagcactcggtgacgggggacatggtcaacccccgctgtaacgtttgggtcaattcggcggcattattggcaatgccgccacctgaacccccgagtgtaaaggctggacgaacaatgaccggataaccgattttttcagcaaacgacaatgcactggtcacgtggtgaacagtggtacttgctggaatcggttgatggagccgcttcataagtgttttaaatgctgcccggtcttcagcttgattgatggtggctagggaagttcctagcagttggatcttcaactcattaagaacgccagcctgatctaacgccatcgctaggttcaatccggtttgtccaccaagtgtcgggagcaaagcatcagggtgggcggcccgcagaattttagtgacactggtcaaagtcagaggttctaagtagacttcgtcggcggtggccgtgtcagtcatgatggttgctgggtttgaattgatcaaaatgacatgatagccggccgctttaaggcttagacaagcctgagtaccggcatagtcgaactcagcggcttgaccgattttgattggaccagaaccgatgacagcaatcgaatgaatggcattgtttttaggcattaacaaccgcctccttttgaattgttagtaagaaatcatcgaaaaattgcccagcttcctggggccccgggtgtgcttcgggatggaattgcaccgacattacggcctggtgcggtaggcgcaagccttcaatgctgccgtcatttaattcagtgtgcgtgacgatcagcggggtgcccttgatcgatgccggatcgacggcgtaatcatgattttgcgaagtcatgataatacgaccgtcagcgcaggcttgtaccggatggtttagcccgtggtgaccaaaggaaagctggtaagtctgagcaccataggcgagcgcaatcaactgatgaccaaggcaaatgccagccagcggataacgttgtgcgagttggcgaatggtcgctaagtaagtgtgatagtcagtcggatcaccgggaccgttggataacaaaattccgtcagggtgatacgcggccacggccttgagactagctgtaggtggaaggacaacaacgtccgcgccccgggcttgcaattcggcagtgatggctgctttttcaccaaagttgagaattgcgatgcgcggccgggtagtggtcgtcgctactgggagtggcgcggccgtaagtgcttggggcacaaacgtggcgagctttgcttcaaaatcagtgatgggatgattacttaagattgccatctgggctcccgtttggcgaatgtgaatcgttaggtcacgagtatcgacgccttcaatgccagccacatggtgggttgtcagaaaattcgccagtgattggcgactagtatagtgatcattaaaagtggccagttcgtgaacgatgatggcttgcgcgccaatcgcgggtgcctgggccacggtcggatcgataccataattaccaattaatgggtaggtgaaggcaatcatttgatttaagtaggatggatcagtcaacgtttcctgataacccgtcattcccgtattgaagacgatgcgccccgcggcctctagctggcaatccccaatcgccgttccaatccactgtgtgccgtctgctaaagttaagtatttgttcatcccaatcgcaccctttctgatgatttgattaaaatttcattttgactaatgggataagtaaacagcaatttttggtgaatgtcaattaaaaatacatattttatgtataaaatgctgaataaagctaattttatgcagaataacaaattaaaatgaatattttttcaatgaagcttgcattttaaagataatgagaatatagtgtgaagcatacttactgcatgaatatgcggctaatatactatttttgaatatttgaggtgattatatgcaagtcgcgctagttggcgttacgggttacagtggcatggtgctgtaccggctcttgaagcaacatcccgaggtcgatcacatccaattatacgggcacgtgggagcaactacggtggcattaaagacggtggcagccatgtaccagaaagaaacggcggttattcgaccattcgatgcgacggcaatcatgcgcgataatgcagctgtgttttttgcaacatcagcgggcatcacgcgagaattggcattgcccttcgtcgccgctcattttccagtcatcgatttatctggtgacttccgcttgcatgatccagagcaatatcagcggtggtaccaacgtgatccagcaccggcgaccgctttggcacaggcgagctacggcttagctgatatgccggcgccgttgtccacctacattgcgaatcccggctgttatgcgaccgccacgttactagggctagcgccacttgttcagcaacagttgatcgaaccgacttcgattgtcgtggatgcgaagtctggtttatccggtgctggcaaacgagcgacggatgcgagtcattacgtcgccgtgaatgataatttgagtttatataagttgaatcagcatcaacatatccctgaaatgatgcaacagttacagcagtggtggtccgcgattcctgcgattgaatttaccactaccttgattccagtaacgcgtggaattatggcaacgatttatgccaaagcaaggtccgcgctgaccacgacgcaggttcgcgcagccttcacggcaacctatcacgagcagccgttcgtgcaagtactaccaacgggaatgccgacaattaaggatgtggttggttccaacaactgtgtgttaggtgttgattataatccggtcacgaataccatcgtggttgtgagtgtcattgataatctgatgaaaggcgccgcggggcaagccgttcagaatttcaatcgctattttgatttcgcggttacggccggattaccgacgttaccggtatttccctgataaggtgcaataagagaggaagttatgcagatgcaagttttaacgaatacgaagtttgaaacggttgcctttcagtggccggcaggtttttacagtgatggcattcatattggtcttcgtcgtcataaaaaagattttggttggctattttcaaaagtgcctgccagtgcggctggaacttatacgacgaatcagtttcaggcagcaccaactaagttaactaaacagatgatcgaccagggccaccaattacagggattgctgctgaatagtgcaatcgccaattcttgtactggcgagcaggggtggcagaatgcgctgcaagaacaagcctggttagcgaataaactaaacgtggcgccgaacttgattggcgttgcttcaactgggctgattggtgctcagttacccatggataaaatcaaaaacggcttgccgcaattgacaccaacgaagagtgacgcggtgacctacgccgtgttaacgacagaccagcatccaaaaaccgtctgtgtgcagtgtgaactcagcggccagttagttaccttgaccggttttgccaaaggttctggaatgattcatcccaagatggcaaccatgcttggttttgtcaccaccgatgcccaaatagacgggccagttttacaggacatgctaagtactaacgttgatcagacattcaatcaaattactgttgacggtgacacgtctactaatgacatggtggtcacgttggcgaatggtctggcagataatccgagtttacaagtgggtaccaccgactatgatatttttaatcaggcgttgcactatgtcttaggccaacttgccaagcaaattgccgctgacggtgagggtgcgaccaagttagtcgaatgtaatgtggtccacgccgctacaacgtttgacggtcagcaaatcgccaaagcaattgttggctctaacctcgttaaggcggccattttcggtgaagacccgaattgggggcgaatcattagcacgattggcgccactgatgcagacatcgatgtggcgacggtcgatattgaaatgaacggcgttttacttgttcaacaaagtctggccgttgactttgatatggcagcagtgcaggcgaccttacgtgataaccagattatgatcgatgttgatttacatcacggtacagcaagtggtcaggcttggggttgtgacttgacttacaactacgtcaaaattaacgcgagctatcatacttaaacggaggtggtgaaaatgacaaaattaattgtaattaagattgggggccaggcgattagccaattgagtaacactttctttgaccaaatcgcacagtggtaccaacagcattatcagattctgatcgtacacggtgggggaccgatgatcaatcgactgacgactcagcttgctttgcccgtgcataagatgaacgggttgcgggtgacggatgcggcgaccttagtgctgaccaagttggccctgctaggagatgcgcaaccagccttacttgcaaaattaacgcaacatcacctacctgtgttggggctcaatgcggcggataatcagttactaactggtgaattgattgattatcaacagctaaggtatgtcggccggctcaccgctgtcaatcaagtgcaattaatgcaattgttggctcatcatatcggtgttttggcccctttagccttaaccgagacgggacaatggctcaatgtcaatgcggatatggcagcgaccgtgctagcccaacaactacatgctgaaaaattggttttgctaaccgatgtcccgggaattatacatcacggtaatgtgatgacgtcactatcggcacaacaagctcagcaattgattcgaacagctgtgatcaccgcgggaatgcaacccaaagttcaagctgcaattgccgcgattcagacgggagtcaagcaggctattattacaaatgcaatcgatcaaccaggaaccgcaattgttcaggaggtggccgtatgaccatgcaacacgtgtttccaacctatcaacgttttccatttgccattacagatggtcagggcgttcatctgactgataatcatggcaagacgtatttagattttacagcgggaatcggggtttgcaactttgggtatcaccaaccacaaattcaggcagccgtcacccagcagttgacgcatatctggcatacgtcgaatttatacgaaaatgaattacaagatgccgttgctggcctgttagcgaatggtgaagagcgactcgtatactttgcaaattccggaaccgaagccaatgaagctgcattaaaactcgcacggaagtacacgggtaaaaccggcatcttagcttttcagcattcatttcacggtcgaacctatggcgctatgtcgatgacgggcaatcctcatattcaggttggctatgcgccattagtacctggcatcacgtttgcaacctataatgacgacgcggctttggacaaaatcacaccagagttggcggccgttattttagaagtcgttcaaggtgaaggcggcgtctttgcgggacaaacagcttggttacaagcggttaatgcgaaatgccaagcaacgggtgctttgttgattattgatgaggtgcagacgggaatcggtcggactggttaccggatggcctatgaaggttacggcctggatcctgatatctacacggttgccaagggcttagcgaatggcttgccagtgggggcaatggttggtcagcggcaattagccactgcctttggtccgggcagccatggctcgacgttcgccggtaatgctgttgctatggcggcggcaaaacgtgtcttgacccaattaacaccggcgctgttaacgacggttcgggcccatgccgaacttgtctggcaagccctagcgactcaagtcgaaccgataccggtagtgaaacaaatcacggggaagggcctaatgattggaatccatttaaatgaacaaatcccggttaatcaagtcatcacccggctacaagtagaaggcttattgacgttatcagctggcgataatacgttacgtttgttacccccaattgtgatgcaaccggccgatttattagctgggattgccttgattgcaaaggtactgacaactttgacaacggaggtcacgacgaatgaataatcaatttgaaggccggtcattcttgaaggaaatcgactatacaccaacagaattagcttacttaattgactttgctagtcacttgaagacccttaaagcacaccatatcccacacccttatttacaaggaaaaaatattgcgttgctgtttgaaaaaacgtcgacacggacacgtactgcgtttactgtagcggctaatgatctgggcgcgaatccagagtttttaggtaaagacgacatccaattcgggacgaaggagtcagttgttgatacggcgaaagtactggggtccatgtatgatggcattgaatttcggggctttaagcaaagcacggtcgaagacttagcgacctatagcggtgtgccagtctggaacgggttgaccgatgagtggcacccgacgcagattttagcggattttttaactttaaatgaacattttggtcatttaaaagggttgacgttagcgtacgttggtgatggtcgcaataatatggctaacagtttacttgtggcgggagcgatgctcggtatcaatatcgctatcggggccccggtagcgttacagccagccccagccgtggtcgcgttggcccaacagtatgcacaggcagctgggagcacggtcgtgattacggctgatccgcaacaagccgttactcaggctgatgcgctttatacggatgtctgggtctcaatgggcgagcaggtcgactatggtgagcggatcaagcaactattgccgtttcaaattaatactgcgttgctcgcagctactggcaagtcatcgacgattgtcatgcattgcttaccagcactacacgatctaaagacgcagttgggagccaaattaggcgaacagtacggaatgacggcgtttgaaattacggatgatgtcttccagagtaagcaggcggtcgtctttgaagaggccggcaaccggatgccagcaattaaggcggtaatggcggctacattaggtaacttatttattcctaccagcattttcaattaacaagcttgcgggaactactagagcgtgctacgattatattcgctttgtttcaatcaatacgtggttcgtaaccatcccacgttaaaaaaactaggaggaattaagcgaatgacacaatcaaaaattcgaccatggattatcaatgccctagtcgctgcaatgtatgttgtattatgcctaggccccgcagcttttagcttggcatcgggcgcaattcaattccgcgtttctgaagggttgaaccacttagccgtgttcaatcgcaagtatgtttggggaattgttgccggcgttattttatttgatgcttttggccccggtgcgagtctcctcaacgttctctttggtggtggccaatcattactggccttgctggtattgacgtggctggcgcccaagttgaagacggtttggcaacggatgttactgaatatcgcattattcaccgtttcaatgtttatgatcgcgttgatgattaccatgatgagtagcggcgtcgctttctggccgacgtatctaacaactgctttatcagagttgattatcatgagtatcaccgcgccaattatgtacagcttggatcgggtcttgcactttagtgaccggattcagtagagtgtgacttttacaaatcagactaaaaaccgttatttcgatgaaggatgagtcattgaaataacggtttttttgtcgagtcattacgatgtcagttgaacaaaataatctaatcgactcatagtgaagttggcgctaagagttcattatgggcagatatagtgcataatgactggtgttcatttcagaacccagacaattatttgaagtaagcacgcgtataatcgttttcgccaaccgcatgatagctgacaccatttaaattagaatttacaaggtgactttcagtcatgttgtaaagcggtacgactgctgctgtttggttgagacgtttggcggcagttctcatattttgccagtatgattgtgtgttagttgcgttctggttgtgtgcagcggtgatttgttgattgaaaacagtgtcatcatagtgcccgtagttttgcggattgttctttgtcagaatgtcgaaaaaggaaatcgggtccgcgtagtctgctagccagagtgtataagtcaaatcgtaatttccgttagtaactgcttcgccggaggcctttgaaggtatcgctgaaactgacactttggcatgtttcaggttttgtgctacagcggcttgaacaaactggtcaatattcttagcgaccgttgtgtcatcactaactagctttaatgttacagaagaacggccaagttgcttgagacccttattccataatacttgtgctttagcaacattgtgtcggtaggtgctttgagtttcagtaccaaaatccttgcccgtagtgggatcggtggttaaacctggtgtgacataattgtaagcaggtgttgaaccatcactcaaaatatttttggtgagtgtttttttattaagcacaagattcaaggcttgacgtaaatattgattgtttaaagcccgatttttttgcatgttgagacgtaaataataagtgccagctttactgacgtgtttcagatgcgagtcattttgaacaccctgcgcggtgacgccggtgacagtagcgtcatctaatttattttgtgagaagagattatgggcagttgtggagtccttgacaacttgcattgttattttatttaacttgatgtcacttttatcgtaatagtatgtattttttaacaaattccaagaatcattagtcccgttccaacctttaacggcgaacgggccattgtaggccatttttgtactagtagttccgtaatctttcccgtatttggacaccacttgatgatcctggggaaagaaagctggcatggtgagcatcttactcaagtatggcatggcgtggctgagcgtaacttttaaagtgtgcttattcactgcagtaacgcccaatgatttaacagatttatgtccggctgaaatttgagcagcgtttttgataccttcgtatatgtaactataaccagaggtagaagtggcactgacagagcgttgccaagcggttacgaaatctttggcagtgacggtgtgaccattactccactttgcatttcgtcgtaagtgaaaggtgtaggttttgccatgatttgttggtttaacgactttagtggccattgcaccgaccactttattctgagcgttcatgcgatagagaccttccatggactgctgtaagacgttccattgtgtaagtgtggctgtatttgaggtatccaatgaggtcaattcactatcctgcatcaaatgcagggttttcctggtggttgtgacattggcatgtgcttgcccacaagcggttagactacttagtactagtaaaaggcaactaatagttgtcaattttttcatcaacattagcgttcctcctcaattaatatgctgtaaattgattggtttcgacatcggtgagatagcgtctcaagttatgtaagaaagcgtctggattatctacactatgacaatgtccaccatctggcgttaaagttaaccgtgcctgtggaagagtttgctgcatacgccgagcgactgatagtggcatcgtatcgtattccccaaaggtgagcaaagttggcgttgtgattttatggaggtttgcacgttgatcccagccatttaatgccccaaccataacgaactcgttattgccctgaaaataattatagacaggtgtagctagtgttgagactaattgacgaggcgcattttccggatggcgacaaacgaagtgctggttgagagtcgtgacaagacgttggtattctggatcatcaaaggcttcagcgctttcaatacctcgcatatagctaacttggcttgctgttaacgtttgttcgcgcaatttattgacgtgtggtgtgtattcggcaatgttatcaatcatactcatgataattaagcctttgaggtgctgaccatatttcaaagcatattcttgagccaataagccaccccacgagtgcccaagtaagtagaaatcttcgagtccgagctgctggcggacttcttctagttcagataaataataatccaaggacaagaactgttgattttcgggccttgaaaagtcaggttgatctgagtaaaaggagcctaattgatcatacatgctgacttgaaaattgtcttcacctagctcagtggcaaagttttcaaattcggtatgattactaccagggccaccgtgaacacataatactttgactggtccgtgaccaactgtacgagtaaataaatgaaaaccatttttgagctgcaccaaatgagttcctgttaacatagaaattcctccttcgattagacaataaaaacgccctataccaatcaagtagttgattgatatagggcgtttccgcggtaccacctattatttgccagtaaactggcctcacttcacgcacggtaaattaagtgacgatgcgctagcatgataatggatgctgccattaagtactcacaaataatgattgcacttaccgtgattaggggattttcacaagatagcagtatgagttcctttcaccagccggaacctctctgaacaattgcttaagtgctactttcctaatcgtcgcgtttaattgttttctaatctttatttaatgttgactactttatcattgactttcatgcttgtcaaatgattttagataaatgacattgcttgttaaaattagcaggtagatttaaatggtttgaaattagtcagcggtaatttaatgctgcatcaagattccagtgtgtgttctactaaggcctccggggctgggtgacaatcgctggaatgtccacaaggtcgatttgagctaacgcactaaccctagcgcgcaatctcaaatatgagtcctattctaagtcggagataattttcttctggcttagaataacttagcatagcaagtacaggcttcagtggcaccgagcacgtttcggtaagctgcttgaatggcaaatgaacggccagcaattgtgacgcgatttttcgactcaaatctgcgcccaccacgttccaacaattgtgagaaatacctggaggtcggtgctaggacgacatactgatgccaactcgaattgcgcccagcggtcttaagcgggtcgcttttgatctgaaaattcatctcattaaaaaaagccccaaggtaacctcggggcaactgatattattcagcttgtaaatcttccacttcgatgactttaaattgtttgcgattcaagttgtcgataattcgtttgagcttttcactgtcgacattttctggcaaggtaaagagcgtccgataaccgagtgtcccgttttggacgtctaaggtcaggcagccggcgattgaagtatatttcgtgataatcttagccatggctgcaagatcaccacgttcaccaacggagacaactgttaaaacatagctaccaacattaacgttccaagattgtgagagcatgtcgagcagacgcgtatgagtgagaatgccatagaaataaccgtgttcatcgagcaccgcaatgtatggcaaatctttgatggagaagaagatgttgtagaaggcggagtcgacttgaatcgttttcgtggcatttttaagcagggtcgtcacgggaagcgacatgtcgccaccacgggatttgtgccggtagatgtgcatcttgtagatattaccgcggaagatatgaccggtttcatctaagattggaatacagcggaagccggaatcttccaggacttttaaggcgtcctctaaggtcgcgtccgccgtaatggtgacgaggcgttctttgggcttaacgagtgtttttaatagcatagcagttggtcccccagatttattagtttgttttaataaataataccataaaacgaccgcttacacgtatcattatgacataaaacgacggctaaaagggatgaaaaagccggcatgataacattcagaccggcttggctaaattagatttaaattagaaaacaatgactggtgttccgactggcacggtagcaaaaacttttttcatgacagaaggtggggtgttcacacaaccatgcgagccgtgcttcttgtaccaagtaccaccatattgagtttgccatgaagaatcgtgaattccttcgccagtgtcatcgaacggcatccaataagaaactggttgggaataacttgagccatcgtcattatcacctttaagggtcgcgttcttttccttattccagatgtaccaaacacccgttgttgtagcgtgtttaccgggctttccagtaacgatgtccgttgaaactttgagctttccatcaacgtagacgtacatatgctgattttctttatcaacttcgacgtaggtgttgccgatgtcagtgcccttgttgttatatccggaaccactggtgattggtgagcgggtaaagtccttgcccttcaagatttcagtagcgagggctttggcttccgattcagttttgatggtccagccataaaacccgccgctgacggatacggttccacgcgccgtactcttgaactgacgcgtcgtatgataggtatgatacttatcattcaattgcttcacgtaagtcagaacagcgttttggtctaaactcactttaccttgcttatcgactttaatccaactgagaattaggtcgtgaggaatcgtgaatttatgaccgttgatattataggtggccttttcggtagcgtatttcgctgattttgctttggccgtctttaaactagcactcgtgctggtaacggtcggagtgacgtaggcgtctttaagggtgatatgactgtcaccattactaattgctttggtgacgaccgtcttaagtttagcttgatctaattcggttccttgaacttctttcttaatctcaacttggttatgttgataaactaacttggcgttttcagtttttgttcgtttggtttgattggcagtcgtggtgattttttgtagtagggttttcaaatcagtatgattgatggttagttgtccaaccgctgagctatcatcagcctgagccgattgcaatagtgcaaggggccaacgccagtagttttgtttggtcactaatttggttaaatcttttttagtattgattgtaataccggctgatttgctggtaaatgagtactttgtttggccgttttcaataattcgataagtgcgatgttctaaagcgcgattaactttcggtgctgcttgagcggcggttttaccactgacgtcaacaccagcgaccgacgtattactgaggaacgtttgttgatgttgccagattaagctcgtggcaacatatccgatgacgaggagaccgaggatactgcccccaatcataagtccacgtttatgtttcataattaagttggtcctccatatattcgtaatattctcaccttataacagaagtgagatgagtgcaaacttcaaggccggtaatcgtgataagaaagttttaaaaatagcctttagtgcgtgttgcgctttaatgaatcgctaaggtaccctcaagcaaataaaaaaacgcccgtctgctatagacgagcgttcatcatacatttaatcgtattaaatgattatttgttttctaattcagctaaaccgtcgttaagcacttttttcaaagttgcggcggaatcttgcatcttcttgagttcgtcagctgaaagtggtgattcgatgatttgtttcaaaccagttccaccaatcacagccggagtcccgatataaatgtcgtttaagccgtattggccgtccatgtaggcacctactggtaaaacggcattttcatcacgtaaaatggctttggaaatccgcattaaagcagtcccgataccgtagaacgtggcacccttcaagttgatgatgtcgtaagctttgttacgaacaccgtcttctaacttggctaaatcttcgtcagaaacgccttgttccttagcgacatcgcgaactggacgtgtcccgatggttgcagttgagtaagcagcaaattcagaatcaccgtgttcacccatgatgtaagcatcaacggaacgaggatcaacattgaattgtttgcctaacgcaacgcgtaaacgtgaagagtctaaggaagtccctgaaccaatgacacgatcctttgggaaacctgagaatttccaagtagcgtaagttaagatgtcaacagggttagcagcaactaagaagatgccgtcaaagccggagtcaacaactggtttgacaatggatgataggatatttaaattcttgttaactaagtctaaacgtgattcaccaggcttttgaggcgcaccggctgtaataacaactaagtcagcgtccttacaatctgaatattcgcctgagtaaatcttcttgggagcggtgaatgcttgggcgtcttcaagatcaagggcgtcaccctttgtccgatctttaacaacatcgacaattacaaattcttcagcaattccttgttgtgccatggcaaaagcgtaactagaaccaacagcgccgtcgccgactaacacaactttttgatgatttggcatgcttgacaaaataagtcatcctctcgtagtgaaaatttagtttttacggttaaagtataccatgtttgtgcaaaataagtgttagattgagcatgcttttaatacaattattaacaatgtccgcaaaaccctttggcgggcgtcaataagccctttgtggtatacttatcgcacttaataaacgctaacttttgaacacttgactggcgggcgcgtcggtcacggtgtgagtagtggtgccaatacgacttaggtggtatcgttactcagagttgccgaatcgggtcgattaccggttcggcctgttttggtatgcaaagtaataggagaagataaaattatgaaaatgatcgttgggttaggcaacattgggcggcaatatgcccagacacgtcataatgttggttttatgattgtggacgaattagctagcaaactaaacgttacgtttcaaacgagtaaatttgaagcacaggtggcaacggcttttcaagacggtgagaagattttactggtgaaacccgccacttatatgaatgattctggacgagcggtgggaccgttgatgagctattacaatgttgatcctgctgatttgctcgttatacatgatgatttagatttgccattaggaaaagtacgcctcaaacaaaagggatcggcgggtggtcataatggcatcaagagcattattagtcatgttggcgatcagcacttcaagcgcgttaaagttggtattgaccatcctcagaagatgagtgtggttgattacgtgttgggaaaatttacgccagccgaggtgacaaagtttgacgatgctaagattacggcgctagcggcggtcgaagcttggttagcaaatgatgattttgcggcagttatgaatcaatataactagcccgggaggaaacgacagaatggatattgaaacgattgttgagcaaacgcccgactttcaaacaattttagcaggtatcagcccgcgtagtcggcaactaatcactggattgaacggttcggcacgaacggtttatttaagcgcgctatttcaccaattaacgcattcattactgatcgtgaccgataacggttttcacgcgagtcagctagtggatgatttaacgagtctcttagatgaagaccaagtttttttattcccagctgaagaaatgattgcgacggaggttgcgacaagttcaccagagtcacgagcgcaacgggtccaggctttaaacgccttattgcgtgacagtccggcagtggtcgtgacctcggttgcaggtgcccggcggttcttgccgcccgtcgcacaatttcaagcagccacgttaccggtagccgttggtcaagatattgatttggaagacttgcagcggcaactacacgacatgggttacgttaaggaaaagttagtcgcacgcccaggagattttgcggtacggggctcaatcgtggatatttacccgttagatgcggactaccctttacgactggacttctttgatactgaagttgatacactgaagtattttgacccggaaacgcaacgttcggtggaaaacttggatgagtatacaattttgccagctaccgattttatcctgacatcagctatgctgcaggccggggcacagcgtcttaaaacggcgattgcggctgaaagtaagaaactcaagccagccgaacgccagactttggccgataatttagcacaacctttagctgacatggaaaaaggaattatcggaaacgatttattattatatggcgattatttatacgaccggaaaacgagtatttttgactatgtggccgctgacgggctcgttatcttcgaagaatattcgcgtttgcttgatagtgagcagcagttattaacgcaagaagctgactgggttacggaccaattggcacatcaccgggtgctggcaactgcgagttacggcaatgatattcgggatttgctccgggatgaccaacatgcacaactcttgatttcgctgtttcaaaagggcatcggcaacgtcaaactagcgcaagtaactaacgtgcgcacacgcccgatgcaggaattttttgggcagctcccagcgttgaagaccgaactggatcggtggcataaccttaaacagacggtggtcttgatggtatcagaggctgagcgtctgacaaaggtcagtgatacgcttgatgattttgaaatcgaagcggtcatgactaaggccactaatttacaaccgggtgcggttcaaatcgtgcaaggtagcttgcaaaatggatttgagtttccggatggtaaattagtcatcgtaaccgagcaagaaatgttcaaaaaggtggctaagaagcgtccacgtcgtcagaccttggctaatgccgaacggttgaagagttatacggatctcaaacccggcgattacgtcgtgcacgtcaatcacgggatcggaaagtacgttggtatggagacgctggaagttgatggtgtccatcaagactacattacgattgcgtatcaaaataatgcgaagatctttattcccgtgacccagttaaacctagttcaaaagtacgtttcgtcagaatcaaagacgccacgcatcaataagttgggtggtaccgaatggacgaaagcgaagcgcaaagtcgcggcgaaaattgaagatatcgcggatgaactagtcgacctgtatgccaagcgagaggcggagaaaggttacgcctttccaccggacgatagttatcaagatgatttcgataacgattttccgtacccagagacgccggatcaaattcgtagtattaatgaaatcaagcatgatatggaacgaccgaaaccgatggaccgcctattggtcggcgatgttggttatgggaagacggaagtcgcgttgcgggccgcgtttaaggcgattgaggccggcaaacaagtggcctttctagtgccaacgaccattttagctcagcaacattatgaaacgatgctgaatcggtttgaaggctacccgattaacgttggcatgctgtcacgattcagaacaactaaggaaatgaaagagacggtccaacagttaaagagtggtgaaattgacatcgtggttggtacgcaccgtttactatctaaggacgtcgcgtttgctgatctgggcctgctcattattgatgaggaacaacggtttggggtcaagcacaaggaacgactgaaggccttgaaggctagtgtggatgtcttgacgttaacggcaacgccgattccgcgaacattacacatgtcgatgctcggtgtacgggacttatcagtgattgagacgccgccaacgaaccgttatccgatccaaacgtacgtcatggaacagaattttggcgtcattaaagagggaattgaacgagaaatgcaacgtaatgggcaggtcttttatttgcataaccgggttcatgatattgataaagtcgttgcacagatcaaagacttggttcctgacgcggcggtggcccatattgatggtcagatgcctgagtcacaactcgaagggattctctacgatttcattcggggtgagtacgatgtgttagtgacaacgacaatcattgagaccggggtcgatattccaaacgtcaacaccttgtttgtggaaaatgccgatcggatgggattatcacagctctaccagttgcgtggacggattggtcggagtagtcgggtcgcctatgcttactttacttatcagcaaaataaggttttgacagaagttggtgagaaacggttacaggccatcaaggactttacggaactgggatctggctttaaaatcgcgatgcgcgacttgtcgattcggggtgctggtaacttgttaggtaagcaacagcacggctttattgactcagttggttatgacctctatacccagatgttgtcagaagcagtggcgaagaagcgtggtcaggcggctaaagttaagaccgatgccacggtcgaacttggaatcgaagcctacttgccgaccagctatattgaagatgaacggcaaaagatcgaaatttataaacggattcgccagctggagaataatgatcagtacatggaagttcaggatgatttaatggatcgatttggtgattatccggtagaagtcgctggactattagcagtaggtaagctgaagttactggcggatgacgcgctgattgagaagattcagcgtgacgatagtgagctacacctaacgttatccaaacaagggacggctaagctagatactaaagatatttttaaggccttggcaaaaacaaaattaaaagcgacagttggaattgatgatgataaaatgaaggttaaattagtcattcagccaaagatgcaacaggatgagtggctggcgcaattaacacagtttgtcgaacaactgagtttgatcttagccgaagacgatgtcgctagtgcgtcttagctcggtagttgttgttatgaagcatggttgcacggggtgggttaagcgctatcgagtggaaccaatggcaaatagcaggaattatcgtctgatggggcgttgtcctggctagtcagggcgcggctcaaatgaattagtatgagacaccgagttgctcggtagaagggatttgttatgccaaaggatcacttgaacaccgtgttcaaaggtgcgttaattttatcgatatcatcattagtcgctaagattttaagcgcggtataccggattcctttacagaacatggttggtaatacgggattttacgtttatcagcagatttatccgctgtacggcattggcatgacctttgcattaaatggatttccaaattttatttctaagttagtggcagaacagccagacgaaacgagtaagtcgctgattgcacggcgggcgtttcatatcttatccggattatcgttggtcgtctttttcggcttgcagcttggtgcaacgtggattgcggcccacatgggtgacgttaatctagcaccaatcattagtgccgtggcttggatgtttgtctttatgccatggttagcaaccggccgtggttactatcaaggaaaatttttgatgggaccgaccgcagtgtcccaactgatcgaacaggtcgtacgggtcgcaattatcatcatggctgcatatttcagtgtccgtctcggttgggataattattggatgggaacgtgggcaatgagttcagcgccactagctgcaatctgttcatcactgatttttactgcttttggtctacgctatttattggcgcccgcacccgcaccgacccacccgttacctagttatcgcaaattaaccaaaagatttgtaattgaaggtgggacgctgtgtcttgtcgccgctgtcgttatcttactgcaattagtggattcatttacggttatgcggggcttggtgcatcaaggtcagttaccagaagtagccaaggcactaaaaggggtctacgatcgtggtcaacctttggttcagttagggttggtggtggcgacggccttttcagcaacgttattgcctgctttgacggatgcgttagccaagcgtcaaccgattgaattcaagcgccagacacaggcgatggttcacgttagtttagcattatcaatggcagcgacggtcggtctagttgcgttgatgccacaaatcaatcgcttgttatttggttcattagaaggaacaacggcattgcgaatctatattattagtattttatttgcagcgttgattacgacgtatacaagtgtgttacagagtttgaacgaatatacggccatgatcattggcatcattgctggattagcgacaaaagtgctggctaattacatcttcgtggtccactatggcatcaacggtgccagtgcggtgaccgtattgagcttggccgtgatgtttgcggtcatgtggttaggttcgccggaagacttgcagcaggtgctattagagagtggttatttgataaaattgctcgcattaagtgccgtaatgggtatcgtggtgatccttagttgtcatcaaatcaccgccttagtaggtccgatactagcgaatacgcgtggaatggctggaattataacggtgattggggtgctaatcggtgtgctggtgtttgttgccggggccgtctatgcccgattattcacgattcgcgagtggttagtgttgccatatggaaagcggctaattaaggccgttgcaaaaggaaaggaacatcattcatgagtatgcgtttagataagtttttaaaggtttcacgaatcatcaagcggcgctctgttgctaaagaaatcgccgataaggggcggattcaaattaacggtaaggtagcgaaatcttccagtaatgttagcgttgatgatgaactaattattagttttggaaataagacattaacagtcaaagtgacgcagttattggaaacaactaagaaaaatgatgccgagctgacgtatgatatcatcagcgaagactacaaaacggattatcgccaaccatttagtgattaggtcggtgtatccgttcatcgaaatggtcgtaaacgttgacttaatcagcatgatgtcgtttacaccggccgatgaagttgttataatttaggcaacccaatttgaaaggactggaccaacatgacgaacgggtcacgtaacaaaatcaagcagttagataatgattatattcgtcaagttgccaccgacgagcatgggcaagcccagcgtgttgcacaagtacggcggcgacggtttattttgattgttgcggtgttcggagcattgatactattctttggttttcagttgattaatacgcggtccaatctgcaccaggtaaaccgtcaagttgcgaccagtcaagttaaattaaaaaaggtgcagcaaaaaaataatcaacttgagagtcagatcaaacagttgaataataaggattacttacaaaagttattacgttcaaagtatgattatacgaagagtggcgaaacggtctacagcttaccaaatgataatgctgcggatgtaactgccaactaatcggggttgtggtctgctttatatgagtagaccactttttattaattgcttaaatgtataactcaacgtttcacaaagtatgctatactaaaaccattatttcataggaggaacaactttttttatggcaattgaagtaggtacaaaagtcactggtaaggtatctgggattactaattttggtgcatttgtaaacttgggtaataatcaaacggggctagtacacatcagtgaggtttccgatggctttgtaaaggacattcatgatgtcttgagcgtgggcgacgatgttacagtcaaagtgttatccgttggtgatgacggtaagattggcttgtcaatccgtaaagcggttgacaaacctcagggtgaacatgaacatcatggcaaccatcagggtggcaaccggccaaacaatcatcaaggtaacaaccatggtcatggtgaacgtcaaagcaatggcaatcatcacgatcggtcaaataatttccatagtcgtgggggaaatggcggcggtcgttaccaatcacgacaacatgaacctaagaagcaggactttgattcattgatgtctggtttcttaaaagatagcgaggatcggctagcaaccttaaagcgtaatactgaaggtaagcgtggtggccgtggcggtcgtcgtagctaaacttagtgacttgccattaatctagttaaattttgaagcacggtgcggctatttagagtcacgaccgtgctttttttattgaaaattgccgattgttcaaggtcagtcagcgagacacgttggaaacggtgtgagttactgtaaacttgcttggctagttcatcttatgctatccagtcggaataatgttcaaataggtgacaaacgaccagccaactaatcggcaagttttaacaataaataaatccaatgtatttataatgaagttagatgggaggttaagatgacaccaattcaaaagttcaatcggcaattagctgcagccaaactgttatcaccacagcaaacagtggtggtagcggtgtcgactggggtcgattcaatggtattgttgcatttgttgcaacgattgccagcagcggaacggccacgggtagtggtggctcatgttaatcatcatttacgcgaacaaagtcaaatggaagcggactacttgcgacaatattgccagcagcaaaacttgcagctagtcatggccgattggctacccgcggcacatcccaagagtggtatcgaagcagctgggcgtcagtttcggtaccatgtttttgctaaggtgatgcgggaaaatcgtgcaacggcagttttgactgcgcaccacgccaatgatcaagtcgaaacgtatctgatgaagcttgcgcgtggtggcgacatctcacaattgacaggaatcgcaactagtcggccctttgcaacgggccgattaattcggccgttgttgacgtggtcgaaagatcagctacgaaactatgctgccgagcagcatgtcgtttattttgaagacgttactaatcaagatgtggccttgacccgtaatcggattcggcaccgtgtcgtgccagaacttatgacggttaatccccagttattaaagcatgtggccgattaccagcaacagttgacaacgctgttgacggctaaaaagcaaatggtcacggtactactgtcgcaggtcgtaacggccacaggggcgttggttgttgatcagtggggcgcactcccgagccagtggcagttagccgtttttgcgacgtggctcgagcagcagacgcaacaactattcaccgagtcgaagttacaaccgctggtctcgtggggacaacggacgcggcctgccacgagtagattaacggtaaacgcggcctgggagttgtaccgtaacgctggtatcattgaagctttgccaataaaaaaaaggggtaaaaagttaatgccccgtgaaaaaattatggtagacttaaaccaatggcagaaaattactgcaacccaaacggtgggaatctttacgcgggtgccaaatgttgtcagtcagccattttggttaacagaagccgattggccgctagtgtggcggccgtggcaagctggtgatcgaatcgttctcaagggcggtggtcatcagctggtacgtcgactgctgattgatcgaaaagttccggctgaacggcgtgaacaggtgcaagtgttagtgaatgctcaagggaacgttctgtgggtggtcggtcataagtttagctatcgtacgactggtacccagacagtatttttagccttaaaacacgagagttgaaaggagtacatctgaaacgatgaacaacgacattgaacgagtactttatagtcgcgaggatatccatcaggttgcacaaaaattaggaaaagaactcacaactgcatatgctggtaagaacccattaattatttgcgtactcaagggtgccgttttatttaccacggacattattcgtgaaatggatatttacgcggatcttgattttattaatttatcaagttacggtaatgaaacgatctctagtggtgaggttcaactaacgaaggacttagatgctgatgtgacgggtcgtgatgtgttagtcattgaagacatcattgataccgggcggacgttgaagttcttgatcgatttgttgaagcggcgcgatgtgaactcagttaaggtctgcacgttattggataaaccagctggtcgactcgttgatattaaggcagattatattggttttgaagtaccgaatgagtttgtggtcggttacggtcttgactatgcagaacgctatcggaacttgccgtacgttgggattttaaaacctgcgatttacgagcataaataattggtcaatgatagtcaaatgtgctattatttagactatcgaagtactgtatataaaagtttcgatgaaggaggcacatatgaacaatcgacgcaatggactctttcgtaatagcttattttacattttgatgtttctgagcttgatgggaattatctactttttctttggcggtaattccggctcacaaacgcaaaatattcgttatagcgaatttgtcaaacaattagataagaataacgttaaaaacgttagtatccagcctagtggcggcgtctacaaggtaactggttcataccggaaagcacggacgacttcttctgcaaacgcccttggtatcaagagcgcatctacaaagacgacgtcattttcaacaacgatgttggaaaacaactccacggttgaccaagtttctaagttggcggctaagcatgacgtcaaggttacggctaaggccgaagaatctagcggcatctgggtcacgttattaatgtacatcgcgccagtcatcctgatgttattcctcttctatatgatgatgggacaagcaggacaaggcggcgggaacaaccgggttatgaactttggtaagaccaaagcaaaaccagctgatagtaagcaaaataaggttcgtttctcagatgttgccggtgaagaagaagaaaagcaagaattggtcgaagttgtcgaattcttgaaagatccgcggaagttcgtgtccttaggtgcacggatcccatctggggtactcctcgaggggcctcctggtactggtaaaacgttgcttgctaaagcggttgccggtgaagctggtgtcccattcttctcaatctctggttctgacttcgtcgaaatgttcgtcggggttggtgctagccgggttcgggacttattcgaacaagctaagaagaacgccccatctatcatctttattgatgaaattgatgcggttggtcggcaacgtggcaatggtatgggcggcggtcatgatgaacgtgaacaaaccctgaaccaattgttagttgaaatggatggttttacaggtaatgaaggtgtcatcgtcatggcggcgacaaaccgttctgatgtacttgatcctgccttacttcgtccaggtcgtttcgaccggaagatcttagttggtcgtccagacgtcaagggtcgggaagccatcttaaaagtccatgctaagaataagccattagcagctgacgttgatttgaaggaaattgccaagcaaacacctggattcgtgggtgccgatttggaaaacctattgaacgaagcggccttgttagctgcccgtcgtaataagaagcaagttgacgctgcggatctcgatgaagcagaagatcgggtcattgccggacctgctaagcatgatcgcgttgtgaataagcatgaacgggaaaccgtggcttatcacgaagctggtcatacgattgttggattggtcttgaatgatgcacgggtcgttcataaagtaacgatcgtgccacggggtcgtgctggcggttatgccatcatgttaccacgtgaagatcagatgttgatgtcgaaacgtgatgcgaaggaacaaatggctggtttaatgggtggtcgtgctgctgaagaaattatctttggggcgcaatcatcaggtgcttctaatgactttgaacaggcaacgcaaattgcccgggcaatggttactcaatatgggatgagtgaaaagcttggtcctgttgagttagaaaatgccaaccaacaagcagcttaccaacagggtatgggtgcgagtgccttttcacaacatacggcacaattgatcgatgatgaagtccggcgtttgagccaagaagcgcatcaaactgctacggatattatcgaatcacaccgtgaacagcataagttaattgcggaagccttattgaagtacgaaacattggatgaaaagcaaattctcagtctgtttaagactggtaagatgcctgaaaaggatagtaatgaattcccaagtgagaaagcagctaccttcgaagaatccaaacgtgaattggaacgtcgcgaagctgaaaagcacgcgcaaaaccaaagtgcggatgataagcaagcagactcagctgacactacgactaatgtgagtgttgctgaaccaagtttcccaagtgaatcggatgctagttcagaagttagtgctgacagtagtgtcaattcaacagctaattcagccactgaatcagctaccgacagtgatgtcgcaacttcagccactggtttaccaaatgctgaaagtgccacaccatcatcgcaggatgatactaattcgcaagcatagtattgaataaagtaaaatgaaggagctgggactttgtctcggctccttttatgcgttatgatatttcaggaaaataaatcaattgcgttaattcggttatgagcgtcgggtcgcaattaaagacggattgagataggagtatgattaaatggcagattatttagtaaaaagcgtcgcgggtaatgagatgtttcgagcgtacgcagttagcgcaacgggcgtggttgctgaagcccaacgccgacatgatacctggagtgcagcatcagcagcgttaggccgcagcttggttggtacgttattattagcatcatcggttttaaagggtgaagaacaaatgaccgttaaaatcaacgggaacggtcctgttggtggtatcgttgttgatggcaatgctaaaggtacggtcaaggggtatttacagcacccccatgtgcacttgcctttgaatgataagcataagatcgatgtgaaggcggctgttggaactgatggctttttatctgtgactaaggatcagggggttggggatccattcaccggaacggttgcgttagtttctggtgaattaggcgaagactttacgtattacttagcacaatccgaacagattccatcagctgttggcttgtcggtgtttgtaaatgacgacaattcgattggagttgccggtggctttttggtgcaagtattgccaaatgcgacggatgaagccatcagctcgctagaaaacaagctcaaagacatgccattagtctcccaattgatgcgtgatggtaagtcaccagaagatattttggatttgttatttgatggtgacgttaaggtattagataaaatgccagttaagtttgaatgcgattgttctaaagaacgatttgccgaagcactaatggctttgcctaagcatgaggttcaagcaatgattgatgaagatcatggtgccacggcagtttgtcatttttgtggggaccagtatcagttcagtgaacgcgaactagaagcagtgctctcacggtccaagggtgacgcttaatgaatcaagagtggcagatcggtgatgtgacgattcccaatcgtgtcgtagtggcaccgatggccggcgtgactaacgcggcctttcgagtaatctgcaaggattttggtgcggggctagtcgtttgtgagatgatttccgatcgcgggatcatgtatcataatcgtaagaccctggaaatgatgtttgttgatccaaaagaacatccaatgagtattcaaatctttggtggttcgaaagcaacactggttcaagccgcccagtttgtcgatcagcagaccaatgctgatattattgatattaatatgggctgtccggtgaataaagtggttaagactgatgcgggcgctaagtggcttttaagtccagataaagtctacgagatggtcgcggctgtgactgctgcggttaataaaccagtgacggtcaagatgcgaactggttgggacgcagagcacgtatatgccgtcgagaatgcgcgggctgccgaacgagctggtgcagctgccgttgcaatgcatggacggactcgtaagcagatgtaccaaggccatgctgattgggacgtgttaaaacgggtggcggatgccctcacgattccattgatgggtaatggtgacgttcagacacctcaagatgctacgcggatgcttgatgaagtcggggccgatgccgtcatgattggccgggcggtagaaggtaatccgtggatgcttacccagacagtacactatttagcaaccggggagttactaacgccacccacaccgatggctaagatgcaaacggcaatggaacatttgcagcggttagtggttttaaaaggtgagcggggcggctgtcatgaattccgtgaacaagcgccgtactatctaaaaggcatcccaaggtcggcacggaccaaagtggctttaatggaggcaagctcgttagcagaaatgatgcgcattttaacgcagtttcaggagcagacggcaacttatttggctagtcacgcggtaaagtgaataattaacttgcattttggcggcgtgattgtcaaaattaacatgtagtgattgtttaggtacggaataaatctgtacgctaactagaaatggaggaacactagtggcacgacaagaacagacgatgaacgaccaactgaaggttcgtcgcgaaaaaatggatgaactgcgtgaagaggggattgatccctttggtcaccggttcgaacggactgatttagcccaggacttgcaagacaagtatggggatatggataaggacgagctagacgctaaacaagtggtggcaaccattgctggacggatgctagctaagcgtggtaagggtaaagtcggctttgctgatatctgggatcgctcaggtaagatgcagttatacattcgtaaagatgtagtcggcgaagatacttaccatatcttcaagcgttctgatattggtgatttccttggaattaccggccaagtttttaagacggactttggcgaattaacgattaaagtaactggtttaacgttcttatcaaaggcgttacgaccattgccagataagttccatgggttacagaatgtggaacagatctatcggcaacggtatttggacttgatctctaaccgtgatagctttgatcgtttcttgaagcggacgaagatcatttcagcgattcggcatcatttagacgatcaaggcttcacagaagttgagacgccaatgttgcataatcaagctggtggtgcggcagcacggccatttgtgactcaccacaatgcgttgaacattgatctctacttacgaattgcgttggaattacatttgaagcgcctgatcgttggtggcatggaaaaggtttatgagattggtcgggttttccgtaatgaagggatggaccgtgaacataatcctgaatttaccatgatggaaacttatgtcgcttatttcgacttccatgatgtaatggctgagacagaaggtatttttaaagccgcagcgcaagccgtaactgacgatggcattgtcacttatcatgatcaaaaagttgatttcaatcaaccatttaagcaaattcacatggtcgatgcgattaaagaaaagactgggattgatttctggcaaccaatgtcaattgaagatgcacaaaaattggcggatgaacatcacgtgaagtatgaaccatactggaaagttggtcacatcattaatgcgttctttgaagaatttgttgaagacacgttgaatgaaccaacctttgtttatggtcatccagttgaaatttcaccattagctaagaagaatgaagaagatccacggtttactgatcgttttgaactcttcatcttaggtaatgaatacgccaatgcgttcagtgaattgaatgatccaattgaccaacggcaacgtttcgaagctcaggctgcggaacggactgctggtaacgacgaagctgaacatattgatgaagactttgtcgaggcgttggaatacgggatgccgcctactggtgggttaggtatcgggattgatcggttggttatgttaatgacggatgcggattcgattcgtgatgtcttacttttcccaacgatgcgtccagaagaagataaataattagatttaaaacggcagttagcttagggtttcctaagctaactgccgtttttgttgggtcagattgagtaactttagttcagaaagcgatttattgaaaaaaagttagattatttttacccgaacattgttgaggtatttgggggctaaaattaagtaaaagcgaattttattgtggcggtaggtaggatttgaagtcaattaacatgattatggttttaaataccgtatattgtcaaagtggattgattaacatgatattattgactggttatttttgcattttagggcttgcaatttatcaggataattggtaaattagtatacgttgttgaggcgcacatagcggttagccgcttgcttccaacggaaattaattataaaaagttgttgacaagatgttgataacttgatatgatgattaagttgcgttgaggtagtcttcaattaagtttggcggaccagcatttctcaaaataaggcatgattcaggcgccagtgcggtcaaactagagactttgcatattgattgcgagggggcgtccccgttccgtatactatgactattaatatgggcgcagccccatgacgattgttactgacgcagcgacaagggggttatggagatgatgaataaacgatatggtatcgggttggcgctgttaagcgtggccctgttagctggatgtgggacccgacagtcgtcccagggcaagacgaccagtcaatcgaccagcacgcaaagtagttcgactaaaagtgtgacggccacaacaaaagtgtccttaaccgcagccatcaaaaagtttcaacagcaatttccgaacgccagcgtgacgagtattgagttggaggaccaactcggccgtccagtttatacgctggaaggcgttggtggcacccaggagcatgaattacagctcaatgggcgaaccgggaaggtcatcagtaagaagtccgaaatgctggatcaagatgaccaagctgacgctgagcgtgaccggctgaatctgaacaaggtaatcagtcctagcaaagcggtggcgattgccgtccatgatcgcaatggcggctatgccagcgagcttaagctcgataaggataacgacacgacttattgggaagtccaggtacatcaaggaaagcaacaagtcgatgttaagattgatgcttacgaaggcagcattttggaaactgaacacgacgattagtgtggagtggttgctggtgaaaaggggcggtgtcctcactttatcagcagctagtcttgaaatggccagcagccattcctcttttaatcagcgagtcggtcaaacacaggggttgagtataaaacgccgatttgatcaatagttagtcgtaatcattacgtccgtttccatcacaccgaattcttgccacatgatttgattgatggtttcgatcagacgtgtgatttcaatcgccgtcatctgaggtggcacaccgatcgtggatcgcagcatgatgagattaccatcataatgagccttgagaaaaatgactttgcggacactcgttaaatcagcaattcggcgttgatagcgatcttcaaggtaagggtcgaaatagtcaactaggttcagactactttctcgaaaaattttggtaccagtattgaggatgtatagccctaagccgatactgatcaggttatcgaaccactgaaggtggagtttgaccgtgacgaggatcgtaagcacggtagtcagactggtcaacgcatccgtgaaggtatcacggctcgctgcggtcagggctgcattgttaagtttgcgactccagtaatgattaaacgcccataggaccagtaacaccacgaaggaaaacccggcggccaagccggcgatactgctgagatttttgaagggggtacgggtggcgaatgtcattacgcctttgataataatgtcgattccaatggcagccatgatggtgccggctagtaaattaaaaatcgtctcaaaacgaaagcgggattgctggattcggggtcctaattgctgctgctccgcgggtgcgatgggtgcgccgaataaatcgtcatcgtgcgtgcgactggcgatgaatagaccagtcatgagtagcccggccgaaaaaattccagataaattattaaaggcatccgcacgcagggcctgtgagtggccccagcgtgcccctagaagctcgataataaataggcccaaataaacggccacgttgccccagagatggtgacgggccgttttaagcgaaatgacaacgggctgttcaatttgatgccaatctggcagtcgttggatcgacatgattaggggcctccttacacatcttgaattggactgctggtcaggattagtggtgctagggtgtctctctggtaaaagtggccaccagcgggcatgtacgaataaaaaaagtgcggaacgtcagaataacaatgaggacactagcctaaacaccacgaaccgatctatgaaggttatccgtttattttactgtaagcctagcacggtgtttttaactttgtcagttggtgctgtttgaaaggtaagtaacctttttggatggtcctatgaaaattaatttctttccaagataaattatatgaaattaattttaaaatctgcggtcatttactttattaacagcgtgttttttggtacgatagttgcgtattaaaaattgggaggcaataaactaatgagtaatgaaaaaccacaaattggtgtcattgggatggccgtcatgggtaagaacctggcgttgaacatcgaaagccgcggctacaaggttgcgatttttaatcggactggtgccaaaactgaaaaggtcgttaaggaccatgctgacaagcaattagtaccaagttataagatcgaagacttcgtggcttcacttgaaacgccacgacggattatcatgatggttaaggctggtaagccaaccgatgccgttatcgatgaattattaccactattagataaaggcgacgtcttgattgatggtgggaacaccaactttaatgacacgatggcgcgtaacgcccgcttagataaatccggaatcaactttattggtatgggtgtttccggtggtgaattaggtgccttacaaggcccttcattgatgcctggtggtcaaaaggaagcttatgatttagttgccccaatcttggaaaagatttctgctaaagcgcctcaagacggtgcaccatgtgtgacttacatcggcccgaacggtgctggtcactacgttaagatggtccacaacgggattgaatacggtgatgaagagttaatcgatgaatcatacaatatcatgcgcaacgtcgcgggcttgtccgttgatgaaatgtccgatatttttacggactggaacaaaggcgaattgagcagttacttgatcgaaatcaccgctgacattttgtcacgtaaggatgatttaggtgcggataagactaagccaatcgttgacatgatcttagaccgtgggaacaacaaaggaactggtaagtggagttccgaagatgccttgaatgttcaagtgccacaatctgttattacggaagcggtctatgcgcgttacatctcaatgatgaagaacgaacgggttgccgcttctaagaaattagctggcccaaccgctgacgttgacttgccagccaaggaagaattggttgagaagattcgtcaagccctctacttcagtaagattatgagttatgcgcaaggcttcgaacaacttcgtttcgcttctgaacattatggttgggacttgaagttcggtgaacttgcccaaatctggcgtgctggttgtatcatccgggcccaattcttacaaaacatcacggatgcttttgataagaagcctgatttaaataacttattgatggacgactactttgctgacattgctgctaagtatcaacaatcaacacgtgaagtgcttagcttagcaatccaagccggtgtaccagtaccatcatttagtgcggcattgtcatactacgactcatatcgagccgaagtattgcctgctaacttgttgcaagcgcaacgggactactttggtgcgcatacgtatgaacggactgaccgtgaagggttataccattacagttggtacgaagaacaataaaatcattttgaatgaactaaactgtggctaatgacgttacgcgtgattaggcgcagtttttttgtgctgtgggtggctgtgcggtaatgatcgttggtttgagtggattagaacgtacgtttgcgttaaaattgagagtaatgaataaacgcgaaagtgggggtcgccatgcgacaagaatcattatttaacccggataaatctagtagtagtccgttggcttaccgggtccggccagtgacgctggcggatttcaagggccaagagcatctacttggcccgggtaaactattacgacaattaatcgcagaagatcagttaccatccttgattttttggggaccaccgggagtcggtaagaccacgctggccgaaattattgcgcaacagacccagtcgcactttattacgtttagcgcggtgacgagtggcattaaagaaattcggcaaatcatggatgaagcggaggctaatcgagattttggtgaaaagaccattgtttttattgatgaaattcaccggtttaataaggcccaacaagatgcctttttaccgtatgttgagcgcggcagtatcacgttaattggtgcgacgacggaaaatccctcatttgaaattaacgcggcgctattgtcacggtgtaaagtgttagtcttgaaggcattgacgcctgaagcgttagaagctgtcttgcagggtgcgttacagaatccgaaggggtttccagatttagagattacgatgcaaccggatacgctacggttgattgccgagtttgccaatggtgatgcccgcatggcgctcaatacgttggaaatggctgttttgaacggtgaccgtgatggcaagcacgttacgattaccacggccggtttatcgcaactgatcaatactaagtcattgcgttatgataagcatggcgaggagcattataatattatttctgcattacataaatcgatgcgtaacagtgatgttgacgcggcgatatactggttgatgcggatgctcgctggtggtgaagatccgttgtacattgcgcggcgtttgattcggtttgcgagtgaagatattgggctcgctgaccggcaggcattaccgctaacggtagcggtctttcaagcgtgccagttgatcggtatgccggagtgtgacgtgaatttgactgaagcagtgacttacttagccttagctccgaagtcgaatgcgttatatgccgctaaatcggcagcccaagcagatatcaaagcgactggaaatttgccagtaccgttacagattcgcaacgcaccgacaaaattaatgaaagatttaggttatggttctgattaccaatatgcccatgatacagcggccaaattaaccacgatgacgacgatgccacctgagttaaaacagcaccggtactatgagccgactagccagggacaggagaaagcctggcaacagcgtctagctgctattcgccagtggcaccagcaacatccgcaaaccgaaccgtcagatgatgagacataaagattgcaatttaatgagaattcactaaaattagatttgggtgaggagcagaccctggttggggtgtaggaaattcagcgttttcatgttaaaataacatgttgtactagcttaatgcaggttagtggtgataaatcactgattcgtacggtttttagataagttgaatattaggagtgactaaaagtaaatgagtcgaatattaattattgaggatgaaaaaaacctcgcacgcttcgttgaattagaattaaaacacgaaggctatgatattcaagtcgaatataacggccgtaaagggttagacgcagcgttagctgaagattttgatgccatcctattagacctgatgttaccagaactgaacggtttggaagtctgccggcgggttcgtgaagtcaagaacacgccaatcattatgatgacggcccgtgactccgtaattgaccgagtttccggcttggatcatggtgcggatgattacatcgttaagccgtttgccattgaagaactactcgcacgtttgcgggcgttactacggcggatcgatttggaaagtgaacaacagagcactaaacaaacgaccgttacttacaaagatttaacgattgaaaaggaaaacttagtcgttaaacgtggtgacgaagtgatcaacttgacaaaacgtgaatatgaactgttattaactttgatggaaaatattaacgttgtcctcgcgcgcgatgtcttattaaacaaagtatggggctacgaatcagaagttgaaacgaatgtcgtcgacgtttatatccgttacttacggaacaagattgaccgaccaggagaaaagagttacatccaaactgttcgtgggactggatacgtgattcgttcttaatgactgacgctgatacgaatcaagtgacgcctaaaccacggcgccgttggtcattaaaatggaaatgggcgctcgggaccgcaattgggtccgcgctcatttttatttgtttttcattattggtctataagagtttcacgaacctcttattgcgccaagaacaacggaacgtggctagtgctgttacaacggtgcaacaatcgttacgaacggagtcgaagggactgaccattaagtcggtggctgctaaattgcaacccgaagcgagcgttgaaccggcaactaccatgagtgaacgtaagcatggtgtgctgcaaagtaaaatcttttcagattctgatttaacagccttatcccgtacaaacttagctgtgacggtttatgatccacacgggaacacactctatctatcccgcaaggatgcacatgagttctctaagaataagacgcgtcaggtggtggtgattggccgaggaagtgatgctgaattagttgggcgggcgcccatttatgcggctagcaatcaccgtttgattggttacacccaggtcaccgataatttggcggaataccattcaacgactcagaatttgatctggatctttattgtgatgacaatgatcactatttttggtgccacgctactgggctatttcttagctgcgtttctattacggccaatgcgtaaaatcaaacagacgattaatgcggtcaatgatgatccgcaaactgactcgcgagtgcccgatcttaaacgcaatgatgaattgtcggatttagcagtcgtattcaatgatatgcttgatcagatgcaacgctatattaatcaacagcaacaattcgttgaggatgtctcccatgagttacggacgccggtggccattatccagggccacatggagttgctgaatcggtggggcaaagatgatccgcaagtattgtcggaatcattagcggctagtttgtcagaaacgaagcggatgcagagcttagttcaagagatgttggacttatcacgcgctgaacaattggaaatcaatttcagtcatgagacgtcggatgttcagaagttagtgacgcaagcatttaacgatttcacgatgattcatcctgactttcattttacgtttgatgatgatgttaaaaagccagtgtatgctcagatttaccgtaatcacctcgagcaaattctgattattttattggataatgcggtcaagtactcgacacgacgtaaagaaatccatttatcattatccacggattatcgctacattgaagtcgccgtccaagactttggtgagggtatttctaaggacaatctcgatcgggttttcaaccgtttctatcgggttgataaggcgcgtagccgtgataagggtggtaacgggttaggattatccattgcgcaacggttagttgaaggttaccatggtcatattagtgttgaatctgtggtgggccaaggctcgatctttcggttccagttaccgattctacgggacgcgaagctcttagctaaggccgaggctgaaacgaatgatgttgaaaagattgccaagtcggaactgccagccggaatccgaccagctactcgtgatgaagatgaagcgcccttggatgatcatgagcacgaccactaggtaatcgaattattgatgaatttaaaacgcacattcaagttaatttaacttgaatgtgcgttttcagtttggataattgtgctgtaatgaattttaaagccgcggcctatgggatcatatcgtgattttgaggtcaatattgagcatcgactgacagttcgatagggcgcagtaagatgctgattaaacgacgaataggttgtacaccagcaggttgggtttaatcctgattcagattgatccgactcgaaacatatttaagctgaccgatatttgttggtatgttcatcatgaaaccattttcacaagtaaccttttttggtatagtggaagagtagttaatttaatcagggggcgaagttgttgacgaacgaaccaacttatcggccaatgacgttcaaaatttttttggaattcattcggctaaatgccaaggcagctagtgtggtgccgtattttattggtgttttattttcaatctattattttcatgcgtttaattggatcaattcgttaatttacttagttgcacaagtagcgattgcattgtttgtgacggggtttaataacgtgcaggattactacttggctaaggatttacattatcgggatacttataacattgttggccgtgagcacctgtcaccacgacgatcattgaatttgatgctagcgatgttagcaactgcaattattttaggattagtgctagtcgtcagaacaaacctattgttactgttcatgggcgctgcagcgattggtgtggctatcttctatacctatggcccggtgccgttttcgcgcttcccgttgggtgaattactgtcaggatgtgtcgaaggatttggcgttttctttctgagtgtttatatgaacgtcgcgacccccgtactggcgggctttaagtttgcttggccgcagtttgcgattgtggggaacttagagaatatattggtcatgattttagtggggctaccagggattttcttggttgcgaatatcatgttagctgataatatttcagatttacaacaggatattcgcaatgaacgttatacggttccgtactatattggtcatcgttggtcactacgggtctacgatacgctagcgctgttaggttatttgccagtgctgatgagtgttgttttacaaatactaccgatttatcagctggcagtgttgctcgttttaccaaaaattttgaagaatattcgggcctttaacgcggtgcaagtgaaagaaaccacctttaatacggcaccacaaaatttgatgatgtttcaaggcatgcaattacttggactgatcctgggtattttcttttaatccggtctgattaattgggatggttcgcaaaaacagcggccgtcatccagcataattgctgaatgacggccgccgttttttgtgtcgctgttttttggaccttgttagtcatgtactgcggttgttttcggcggctatttactgatcaaccgcacggtactgcggccatcccccatctttttgatgagaacttgttggccaatcgttcgtttcattgattcaatgtgactgataacaccgaccattcggttttcaccaattgtttcgagtgcctgcatcgctttttccaaagtttcatcatccagggagccgaagccttcgtcgacaaatagtgcgtcgatttggacgccattagccgaagattgaacgacctcactgagcgagagtgcaatcgacagagcagcaatgaaggtttcaccaccagacaacgtgttggatgaacgcgagttgccggtctcattatcgtaaacattgatatcgaggccatggtcactgcggttatcactcgcttcggcagctagttcaaatgtgtagcggttattggaaagcaggttgataaagtgatcattggcgtagtttaagacgcgttgcaagtagttttggacaacgtaggtctctaacttgagcttgtgatcgttgccatctttaccagtcatgatattatacaggcttgtaatttcggcgaaccgctttgcaaatgtgccttgctggtgcatgatttgttggactttttcgagacaactttgcgcgtcggttaaggcttgttccgccacggtttgggattgcagtgctcgatccttatgagcttgcaggtcggccagctgagcttggatgcccgtaatattcggtcgttcaacgttcgttaaggcggtttgcagttgcttgatttcggttgtcagacgctccttgtcttgccgataggtggcaatttggacttgcagggcggtcagtcgaccattggcgagttcttctaaccaattttcaagtacggtttggtcatgagtcggtgcttctggagcagctaaggcctgtgcgattgtttgctcaagctgcgtgcgcgtggcctgtgttgtcttcaaccggtcgtttaaatcatcgagcttagtttgatgttttgataaagtaagttgactgatttgaacggtggcttgggcggcctctaggcgttgttggtaggtcgcgacgatctgattgagatgcgctttttcggccagcaggtcagcgcttgtgacttgtaagtccgtaccaatggctgcctgagctaccgtcaaatcggctgttttattgcgcaataaggcccgttgttcgcctaactgtaactccgtttgttgggcctgtttttgttgtgcttccagttcagcagtatatttctcaatagcttgaaccactcgttgggctgcctcaagcttcttcgtaattgtggcgagttgctcagcgaaaaaagccctgactgcggtcaaatcgtagggtgacttgagtgctagtccgttggtttcaatcaactgttggtaagttgaagttagttgcgtttgggcggtggttacttgctgcgtagcctggtcaacttctgtttcagcctgttcgacacgttgttgagttgcttccacttgcttgttggctgccgccagcgcgttttgagcgtcgtcaacggcttgcatggattgtcgtaagtcagcttcatttgcaacgatggttgtgaccggcatctgtgaatgatcggttgatccacagaccacgcagggctggccgtcaacgagttcttgttgtaattgggcaatcattaagctttggcgttgaccacgttgttgttcaaattggacttgcgcattgtgctgattctgttcatcgcgggcaagctgcgcccgtaaatcagtcagttgcttggtgacgcgctgctgttcttgttgcgcacctcgccattgactatcaagtggtgtcagggtgtcgacgaactgttctcgttgtttaatcagcaaatctttagtggcgtgtaagtcatcaatagatggcaagttcgcttgttgggtggtgattttggctgttaatgtctttattacggtttggtgctgttcaaaagtcgccttcagatcagcgacactcggcttgagctttgcgagctgtgcgatgagactttcaacgcgttgcgcttgtggaatcaacgtggccaattgttccaagcgctgctggtgctgatggttagcttcactttggtcatgtaattgttgaactgcagcttgcgcttggcgatagtcgtcctgcgcttgttgcacgttatccatagctgcttgctggtcaagtgtcaattgcttttggtcacgtgtttgttgagtgagggcttgcatggtggcttgtaggggctgggcccaagttaacgcgtgcaactgttgcttggctatggtaattgccggtgtttgttcttcaactttagtttgataatcagcttgcgcctgtgtgagccggtcaaattgttgttggcgatcgcgtgcttgctggtaggtcgtttcggccgctttaacagaccgattgattttactagtcgtttgctgtgcttggtcaaaagcactttgacgcgtcgtaacaaatgctcgtagtagtggaattttttgattgtccggaactgcttgaagttgagcctgttcctcatcattccaagttgctgaggctagtgcgacccgcaaatcggcgacaaactgatcaccagtcttgctggcggtttgatactccgctttaagttccgcagtaaagtctgaataaagttgcgttccaaaaatctttttaagaattttttccttgtcagtcgtttttgactttaagaattccgaaaagtcattttgggggagtagaatgatttttttaaattgatcggcagtcaaattcaagatggtcgtgatctcgggaccaacgtcggccggtttggttgcaatgctctcaatctccacgccaccaacgtgatcaacgacagctaatttggccgtactattctttttcgtcagtccagaaccctttttcttagctaagtattgctcaggggagcgcgcaatcttatagagttgattgccttgctcaaagtagaaggtgacgcttgtcggttggtcggcgggggcaaactggctgcgcatctctttggctgcccgaccatccgtcccatcattcgtcgtactgccaaagagggcaaaagtcatggcgtcgaaaatagttgacttaccggccccagtatcaccactaatcagaaaaatcggcgtactttctagcttgctaaaatcaataattgaatgttcgtgggggccaaaatagttcatggctaaataaacgggtttcacggctaatcctcttttcttaagttgacaaaaatctggtcgacgagttgttgttgtgtcgttgagagttgtttaccagtaatcgcgtggaaaaactgcccaacaattgcatcaggactcagttcgttcatgtttttggggccactgatggcggtggcttggtggttcgattcgtagtccagttcgacaatcgtgccgtagatttgttcaagctgtgcccggacgttcagatgcttactacggtcgaattcttggacggtaatcgcgaaccatgcttgctttaacggctgttgctgataaaagttgggatcaagtaacgtttcccaaggcgcacgcaacgtaaccaagtcagtttgcggctgaattggtttgaattcatgggtgatcgcagtgggtgtgattgtcacgatctcaacacctttgccatggaacttagggttgacttccttgacgttgaatttgacgggactgcccgaatagcgaatgcaatctttgtcgggtgaggctaagcgagtgtgaatatggcccagcatcacgtagtcgaagtctgcgaataaatcggtggtcagcgtcgccaagccgcccactttggaagtcgtttcactagtcagttccaagtcgtcatccgctttgggtgtaacggtaaaatgggtaatcaacaaatgccgttttgcaggatcaaaggtggcaacgaggtcactaatcacgcgttgcatcgcatcgtgaatggtgtgaatcgccttgacctgcttttcaggcaaaccttgttgctgatagtagacccgcgcgtcaatagggtcaaaaaacggtaacataaagatttgtgccgttggggtctcgatgggcgtgaaggcctcggctagtaacgtattgatatgaaagttattataggctagccattcacgaccatagttgagacgcttggcgccatcatggttgccagcaatggcatagattggtaagtgatgctcgatattaatagcctgcagcatgtggtcgagtgaagtgaccgcatcggtacttggcacggcccggtcgtagatatccccagcaatcacgataccgtcaactttttcagccaatgcaatcgcgaggatctgcttgaacgctgcttcctgttcatcaagcaaagaataaccattaagcgtccggccgatgtgccaatccgctgtatgtagtaacttcatgaaagtttccccctgagtttgaattgttaagttccattatcgcatatttacataaaatttcaggaaacaaagtgtcgtttgctcaaagtggattgcttttgacgaaatacgttggatttagttcggcatgttggcggacaagtgacgttgattgagtcttgattgtcagaaaaagtcattgcatttttaatggattaatattaatattggattataaaaattaagtgatgatgagaagagtagctagttaataaatttgaagcgaccatggatagtgaaagcatgtgaatttagtgctggtgaagatgagctcggagcatggtttttgtgcaagcaaaagctgcgggtggtgccgttatagaccacttataagtggagccacgtttgactgttggctcaactcaaaggtggtaccgcgggaaatctcgtccttatgttagttaaggacgggattatttttttagttggaggacatcgttatgagaaagaagtacttgggatttggaataaccatcagtggcatgattttattactagttggttgtggtcgtgcaaccagttcagcaacgcatcacagtcgaactttaaacttgatgcaaacggcaacactgacaacacttgatagtaccaatcaagcaactttgccagaatttaatacattagtaaatacaacggaaggactttatcggttaaacagtcaggatcagccagtaccggcgatggcgacaaagatggtcaagccagtgcaccatggtacagtgtatgtttttcatatccgtaaatctgctaaatggagcaatggggatccggtcgtggcgagtgattttgagtatgcgtggaaacgagccatgaatccggctaataagcccgtgtacacgtacatctttagcggtattaagaatgctgatgcaatcaatagtggtaaaaaaagttatcggagtttgggaattaaggcgactgggaaacgaactttaaaaataacgctggatcatccaattgcagctttcaataaactggttacggttccggtgtttctgcctcaggatcagaaatttgtgactaaggttggaacttccagatatggcaccagtgcatcaacgacggtttctaatggtgctttcaaagttgcaagttggacgggttcaaacgatacttatcttctgaagcgtaatcgctactattgggatcagaaagcaattcatcttaagcagatccgatatcaaacggttaaggatgccaacacagcgcataatttattcgaggacggcaaactagatgatgcgactatttccggtgtgacggctaaaagtctgcaacatgatacagccgtcaaacatgttgaccgcgcatggacttattatttgcaagtaaatcaacgggcgggacaaccgttagaaaaccgaaaattgcgtcaggccctctcgttggtgattaatcgacagcaacttaccaagaccgtcttggccgacggttcaaagcccgcctcgagtttcgtaagtccgggtacggcggtcgatccgacgaccaagcgcgactttagtgcagaaaccagcacttcgacgaaagtgaatattgctaaagccaagcgcttgtgggccgcgggattgaaagaaactaaggtgaagggaacggtgcaactaacattggtgggtgatgaccaagatgtgaccaaaaatgtggctcaatttgttcaacagcaagtgcaacaacacttgagtcgggtaaaggttagtacgaaaaacgttcctgacaagggattacagaatttgaaaagcgatggtcaattcgggctcagtcagtggtattggttagctgattttgctgatccggtcaactatcttggggttcttcaatcgggtaatagtatgaatagcggtaggttcagtgacaaaacgtatgatgatttattgacgaaagctaaacaaacaagcagtcaaaagcagtattggcaaagtttacgtcaggcggctaaccgattacaaaaccaaatgggaatagttccgctgtattatgttagtgaaacgcacctggtgacgcacaaactcgctggtgttgagtaccatgctgcaggggaaactgattatactagagcttactttaaataaaggtgtgataaaaatgaaaaaaattggaacacaaactcaaactgaattctttaatatgattgatactggctactttattgtatattttggtgctgattggtgtcgcgagtgccagtatattcggcccaagttaccgacaattgaacatgaattttctcagtatcgttttattaaggttgaccgtgatgaaaatatacagctttgtttggaattgaacgttcggggattgccaagctttattgcatatcgagaaggtcaagaaatcggccgatttgtgaatggaaatttaaaaacacagcctgaaattgaaaactggatacgcagtttgaagtagtctgtcagctgttattaatctacttgaaaacccaaaaaataagtggggcaatcatcggaatcgttatcaaaatggaatttgctgatgaacatgaacgtcccgacatcaaatttatggattcaatatttaagcgcgtcaggcggtgctggaatgaccggcagacattttcttgctcccccacttgccggctacaaagcaagtggggaacttcgtaaagttgttggcctgactaacgctaaaacggacaaagtaccccacacatcaccgaatcaaactataattgtttgcaacaggtaagcagttttatgcgctcttaacttctagtaacaatgggttggaatacgccgttgtgtgaaagattggtagttgtatggagccaaatactagttcgaacgagaatgggggctgactcatgattccagaaaagtggcaacagacgcttggagttaaattactcgtcgtggtgaatttaatcaatttggtcatcttagcggtggtcaaactgggcaatcgtggacctgtgtggcgagttcgtaatgcaccgttagccgtggttggtgggttgtttttaattgggcttagtttgattttgatttgtaaacagaattccaactggcgcaaggggacgtatctcggtgctgatattaacttgaccgttttattctatttgttactcattgatttcaatcggattgtcacgattggctttgcgctgattgcgctgattatctcgattgtggcactaccgatggcgtatgtgcctcgtaattttttggttggaatccggattccgtggacctatttgtcagaagaaaactggcatcggacgaacgtgctagcaggccgattgtttggcatttcaggaccgctgttagtagcgatgggaaagatgtccaccaagtcatttctcaatgtctttgttatactcatcgtgttagtcgtgattttgaccgtgggttattcctaccggctaagtaagaaattgatctaatcggcctggcagcgttaattggcatcccgtggtaatgttcgtaaaatcagttaaggggacggctgtatgccagttaagtgaaacgtaaaaagcaccgccatgagaattttcatgacggtgctttagtgttgattaagcttcagttattatttatgatgtcgttgttgtttaccggcattccgaccacgccccgcattattttgcggacgaggatgactaagcttggattcagttgcactaaccggctttggttgcgtcggtgttggtgttttgattgggtgctttttgagttctgcttcaacttcgcgccgaatacgtggccggaagaagttgatgatcagtgtttgcaagcaggcaaataaaccaccaacgaagaagtaaagtcctaaacctgcgggagcggacatggaaacaaataaaatcatgaccggactcataatgagcatgagacgcatcgtcttcttctgttcttcaggtaaaccaatcatggataggtaaccctgtgccaagtaggataaaaaggctaaaatggctagaatcagactggatttcccaagggagattcccataaaggtcgccttagataattcaggcgaatagcgaatagcgtagtacaaggcggagaaaattggcagttgaatcagtagtggtaaacagccaataccaccagtcatactaataccgttgtcacggtaaagttgcatgagttcattactgattgcggctttttcttcctgagtcgtcgctgctttttgccgtgcctggattttttccatctgtggccgaactgcggacattttttcttgttggtaagtcgatttacgttgctggttgatcatcattggtagcaagacaagtcgcacaatgaccgtcaagccaatgattgcccaaccgtagttgttaccgaatagttgtgacaaccattccatcacgttttgccctggctttgcaaggtactcgtagacgaatccgtatggtttaccagctttggtcgtttgcacacaaccgcttagaaacagcgctaacgttcctaaggtgatggtgagcgtaaggcctttttttgatttcactagttaataatcccctttgttaaagtcatataatgatgatgatactaaagatgtcgggggaattcaattggttatccgaaaatcatgatagttttgtggttcaacttcgtggacttcgaggtgcttgactttgccaagatcagtgggggactgccgaacaacgtcgataaagacttgcactcgttggtcttcgccctcggcttcaataaagactgagccgtccatcaggttacggacgattccgttcacgccgcatttgtcagcggcaactttagtggcccagcgaaagcccaccccctggacccggccggttgcttttaatgttactgcacgcattgtgtcacttccttacttaacttgttcagctagtgtaatacatgactagcaccctgattgttgcgattgccgattgtattgcgtcggcataattagtacaatcagtattacctatataatagcatggaaatgttcaacgggcgatatgctatactggggataaatcggcattttgacgatgtttcggattcaacgatgacccaaagtgccaaaaactggccagaccagcggatgttccaattgattaagattaaaggaagttaacgatggaaaaaattaattcattacagaatgtgcacgtcaaggcgtggaagaagctccaaacaaagaagggacgcaaacaacagggacaatacttgctagatggttggcatttagtcaacgaagcagttaaagcacacgtcgcgattaagaccttgctcattactgccaagcaactggcgaccgaaccggacttgactcattttccagcggtcattgaaatctctgatgaagttgccaaacatatcagtgcgacggtgacgccgcagggggtgtttgcgctggcgaccctgcctgctgcaattgaagatctatcacaattagatttaacgcggccttggttactgctcgataatgttcaagatcccggaaatattgggaccatggtccggactgcggatgctgcgggttttgccggcgtcgctttcggtaccgggacggtggacattcatcaacccaaagttgaacgagccatgcaggggagtcagtttcatttacaactgatcagtactgatctcgacaagttggttgaccaattgcaggcgcagggttcaccagtctacggttcagagttaaatccacaggcagcccggtatttagatattgacgcgccggctagttttggcttgatcatgggaaacgaaggtaatggaatgagtcaggaattattggcacggacagaccaaaacttatacattcccatcaagggacaagcagaatcgttaaatgtagccgtggcagcgggcgttttaatgttcggtttatatcgctaacttacaattagtaagaaaatgctaaaatccaggtaaaatacttccaaaatggcgagctttttagtagaatagccgtagatattagcaaagggagctttagatgaaaactaataatgcgtggcaacaagattctgaatacgtggcgatcgtcgaagacttattagcacagccggccgttcaacgactagctgagtttacacagcaccaccattcaaatcgattggatcattcgattgcagtttcatatgatagttatgttttagcgaagaaatggcatcttaatacgacggcagtggcgcgtggtggattattgcatgatttgttttattatgactggcgtgaaaccaagtttgatctcggatcgcacgcattcatccatccgcgggtggcgttacgtaacgccgaaaagttaacaaaattaacgcccatggaaaaagatatcattttgaagcatatgttcggcgcaactttagctgtgccgaaatatcgggaaagtttgctcgtctctttagttgatgattatgaagcagaacatgaattttttggaccattgcgtatgaaagtggccaaacaactagatcggttccgaggcaaggtctccgccggttaattcaataattgggggtcattgcatgtcagaaatactagctgacacggtaacagaatccaacgtggattttgaactgtgtccaaaatttgaaaagacgttttcaattctcgggaagaaatggaacgggctaattatcgatgttttactggaagacggtccccaacgctttaagaatctggctcgtcagattcctaagtgcagtgatcgagtgctcgttgttcgcttgaaggaattggaagaaaacggcattgtgagtcgggtaacccattgtgactctgccctgatcgagtatcgcttgaccactaaagggcaagatttacggcaagtgatggataccgtccatgactggtccgataagtggtttagtccggccgaatcctaatacggggttgacgtgcagggcactttgccataaactgacaatgtagataaaagccttgacgagaaatagtagttagttacggcgtcgtagggaagggtgtcaccgattgaaagcaccctggcgaccaagattgacgaattcactctccgagctgaaattgggcgtttgtgaaaacaaataattttccggtatcccgaccgttatgacgggttatgagtgtgcatagtaattacgatgcaaacaagggtggtaccgcgatgacctcgtccctttttagggatggggtctttttttgtccgcaacgcaactaaaaattggaggcagcatatgagtttacaagatcgattaaccgaattacgcgatcaaggcttggccgatattaaatccgccgatgttttgaaaaaggttaaccaagtcaaagttgatttgcttggtaaaaaggggccgattacggaagtattgcgcggaatgcgcgacttaagtcctgaagaacggccaaaggtgggggcttatgccaacgaagttcgtgaccggattcaggcggcgattgatgaacgccgcgaagaattggaacaagcggccgttaataagcaattggctgctgaaaagcttgacgtgacattgccgggacgggaagtcccacaaggccagccacatgtgattacccagatcattactgaattggaagatttatttatgggaatgggttatcaaatcgttgatggtgacgaagttgaagaagattactacaactttgaacggttgaacttaccgaaggatcatccggcccgtgacatgcaggacacgttctatattactaaagacgtattgctacggacgcagacgtctgctgatcagccgcggtcacttgaaaaccacgacttttctaagggaccattgaaggtcttgtcaccaggccgcgtctatcggcgtgatacggatgatgccacccattcacatcaattccatcaaattgaagggttggtcgtagacaagcatattacgatggccgacttgaagggtacgttaatcctagttgccaagaccttattcggcgaccagtttgatgtccgcttgcggccaagcttcttcccattcacggaaccatccgtagaagctgatgtgacttgctttaattgcaatggtaagggctgcgcaatctgtaagcaaacgggttggatcgaagtactgggtgccggcatggttcacccccacgtgttagaaatgtctggcattgatccagaagaatatggtggttttgcctttgggttaggaccagaccgctttgcaatgttgaaatacggtgttgacgatatccgcaacttctacttgaatgacgtgcggttcttgtcacagttctataagaaaggttaggcgtccacatgagaatttctacgacatggttacgcgattatttgaagctggacattccggccgatgaattagcagaaaagattgaacggacggccgttgaagttgacggtgttattcgtcccagtgaaggattgaaaaaagttgtagtggggcacgtcttaacgtgtgagccacatccagattctgatcatctccacgtttgtcaagtggacgtaggcgaatcagaacccttgcaaatcgtttgtggggcacctaacgttgcggctggcgaaaaggtgatcgtggcgttacccaattcatggattggtggtcacactaagatcaagaagagtaagatgcggggagttccatcaaatgggatgctgtgcgccttagacgaacttggttttgatgaaaagttagttcccaaagaagttgcggatggtattttcattctgcctgacgatgccacgccaggtgatccggtcttttcatacttagggatggatgatgaaattattgacatgtccgttacccctaaccgtggtgacatgcttagtatgaatggtacggcgcatgaacttgctgccatttacgaccagcaaccaacgatgccgaaagttgatttgcatgaagatgcgacgacggtggcggcgaatgacttacatgtggctgtcgctgccgacgaacatgacgttccaatgtacaaaatgcgtctaattaaaaacgttacgattaaaccaagtccgttatggcttcaaattcgaatttggaatgctggtatgcggccaatcaataacgtcgttgacgccacgaactatattttgatgcaatatggacaaccgctacatgcttttgattttgatcaattgaatgacggtcaaattaacgtccggttggcgaaagctggcgagcatttaacaacgctagatggcgaagatcgcgaattactcgcgagtgatctgttgatttgtagtggcgatcaaccaatttgtttggctgggacgatgggcggcttagcgaccgaagtcactgatcagactacgaccattgcgttggaaggtgcggtctttgatgcagttaagattcggaagactgcccataatcatgacttacacagcgaagcttcaatgcgctacgaaaggggcattgaccacggcatgaccgcaacggccttagacgctgccgcagccatgattgcagaacttggtgatggccaagtcgctagtggtatggttatcggtcgtgatgaggatgtgcaaccaacgacagtaaccattgacttagcacggatcaaccacgtcttaggaactgagttgtcattggacacggtcagtgatattttcagacgtttagacttcccaacggtcgttactaatgaaacgttcacggttacggtgccatcacggcgttgggatatccatattccggctgacctcattgaagaaatcgctcggctatacggttatgataacttaccagcgaccctaccaacgggccaaccgacgatcggtaagcttaatgagacccaacaggtgattcgtgactcacgtaagttaatggaaagcgctggcctcacgcaagccatcagttactcattgactacggaaactaaggcgaaggcctttgcactccatgctagcgacgtcactaagttagactttccaatgagttcagaacggaccacgctacgcttgagtctagtttctggtttgttagatgatttagcttataacaatgcccacaaggaacacaacgtggctttgtatgaagaaggacgggtcttttacagtcaacccgaacaagtccggccgaaggaaattgaacacattgccggagctattacgggttccatggttcaaaagagctggggcgttgccgaacaacccgttgatttcttccagattaagggtatcgtggctggttatctgaagagtctggcgttgcaagatgccgttagttacgttgccacggctgaccatccagagatgcatcccggtcggacagctgatatttacgttggtgaccagttagtcggtttcgtcggtgaagttcatccaacgactgccaaagcctacaagattcgggaaacttatgtctttgaactggatttaacggcgttgattgccttaccaaaagcgcgtcaacagtatcaaccgatttccaagttcccaagtatcacccgggacgtggcgatgttgattgatgacgatgtgaccaacgcaactgtggttgccttgatcaacaagaagggcggcgcgcatttacggcacgttcaactctttgatgtttataatgggagtcacgtacctgctggcaagaagtcactagcttatacgttaacgtatcaagatcaaaatgcaacgttagtcgatgatgacgttacgactgcttttgaaaaagtactgacagccttaacggatgaattaggtgcagagattcgttaatttgttgatagtcttgttaaacgccgaatgatttgaagtcattcggcgtttaatgtgtgtccaagattctaaaaaaccataaaactaatggtgaactagtgcaaactgggcaacagttttgtataattgataagattaatcaataaatggaggggcgagtcttgaataacaaccaggataaccaagatcagaaggatcaaaacgattcacaagatcgtggggtaaatgaacctaatcgttcagaacaaaaacagcggaaatcattttcgaaacacgttattggtggcgttgttggtattttagtcgtacttttaattattgtgggggtattgggttatcgatattttgataatgcgacgcaaccatatgacagtagcgacaatcgcgtcgttcaagttgatatcccgtacggtgctaatggtaagaaaattgccgatattttacagcgcgaaaaggtgatcaagagtggttttgtctttgaatactggacgaaagcacacaacttatcaaactttcacgcgggctactatcagttgaagccttcgatgtcacttgctcaaattgcgaaggccttgaataaaggtggttcatcggaaccggttcagagttctagtggtaaagtcctaatcgttgaaggtagtcagattaagacgattgcgaagacggttcaaaaacaaactgatttcacgtcggcagaatttctagccttaatgaaggatcaaacattcatcaaatcattggccaagaagtatccacaattgttgaattcagcgatgagtgctaagcaagttcgctatcgtttagaaggctatttgttcccggcaacttatgttgttggtaagaaaacaactttgaaacaattagtaacgcagatggtttcgaagactaatgatgagcttgaaccatactacgcgcaaattaagaagtcgaagatgtccgtgcaagaagtaatgaccttagcgtccttagttgaacgtgaaggcagtacgacgaaagatcggcggttgattgctggcgtcttcttgaatcggttagatgctaagtggcgcttggattctgatatttcagtgttctatgcgatcaattctaacaagtcaacgttaacgaataaagatttgcagactgattcaccgtataacttacggttgaacttaggctacggccccggaccgttcaacagtcctagtttaacatcgatcaaggcagtcttagatcctgcacaacggagcaagggttacatgtatttcgtagcagatttgaagactggtgatgtctattatgcaaaggatgctgcgggtcacgcggcaaacatcaagaaggtttcgaagcacaacgaagccgctgaaaaataagaatgaggcgtaacttaaatgactgaaaataaacatcgccgaccagtagtcatcggggtaactggtggttccggtagtggtaaaactacggtcagcaatgcaatttacaaccaattatctggtcaatcattgttgatcttacaacaggattcctattacaatgatcaaagtgaaatgacaatggctgagcgccatgccgttaattacgaccacccactggctttcgatacagatttgatgattaagcaaatcaagcagttgctggcctatcaaccaattgaaaagccggtctatgattacgagcagtatacgcgtagcgacaagaccattcatcaagaaccgcgtgatgtgatcattgtcgaaggggtattgatcctagatgatcagcgtttacgcgacctgatggatattaaggtgttcgtcgataccgacgatgatattcgaatcattcggcgcattcagcgtgatatcaaagagcggggccggacactagactctgtgattggtcaatatttggcgacggtcaaaccaatgtatcatcagtttgtggaaccaacgaaacgttatgccgatctaattgtgccagaaggtggcgaaaatgaagttgccattgatttattgacaactaaagttcgttcaattttataaaaaataacgtcttaaccagcgctattttagatttaagagtttacttttaaaatctgaaatggtaggctggtttttgataactatattgcgtatttgaggagtgaaacacattggctgaagataagacatatccaatgacagaagaaggcaaggtcaagctggaaaaagagcttgaagaccttcgaattaatcaacgtccagaaattattaatcgtattaagatcgcacgtagctacggtgatttatcagaaaactctgagtatgaatcagcaaagaatgaacaaagcttgctagaaaaccggattaagacggttgaacacatgcttcaatatgctgaaatcatcgatagtgacaagattgacgaaacggaagtctccgttggtaaaatcgtgacgttcaaagaattacctgatgaagaaccagaaagctacaccattgttggtgctgccgaagctgatccaatggttggcaagatttctaatgattccccgatcgccaagggcttgattgggcatcacgttgatgaagaagttgccatcaacattccagccggtaccatgacggttaaaattttgaaggttgaaaacgcgtaattttatgcttaagactgttttgaggtagaggataccttgaaacagtcttttttggtggtttagaagcgcgattactgattaccagccactatttaacgaacgttactgaacaagcacgtttgcgtgtgagttcggaactcaagcaaaacacccgcttatctgcacaaagcaggtaaacgggtgagtaaatcggacacgttacaattttgttgagcatttactatgatgaaaacatgccagttggttgggttactgttcatcagcacttgcacgtcctattccgacctccggggctgaggattagcctagctagggcgttaagcggtgaatttccgcttggcgtcatagcgtagctaaccggaagtctcagcctgacccgaacacgtttcaccaatatggcgttaaagcgtggaagaccagtatttaagacgtggtttgtggcttaaatctttgtccaccacgtttcagcaattggcagagatgcctggaagtcggtgtaggacgcgctcaaccaagcaagtctatacgaactcgacttttcccagtgggtccatagctggccctttttgaacttaaaaactggcatgttttaatcatgattcatgacagattgatcaggatatggccgacagtaaagtaggattagatatagataattcgtaattcaccaagcgagacgctgccggttagtatgacacccgggccagcagtggtcggtgtacctgtcgatgagatgtggcccattgagttgctgagattttcctgtagctgccaagtttgagggaggtataactcaaggctacctaatgaaacgtcgacattgatggttgctcggccttctttgatgtcagcgtcatcgaagtagattttggcaccagccattgatacgttcagatccgcagaacgaaaattttcgctgtgaacgtagcggatactgttgcctagtgagagatctaaattaacatggtcatcgttgattgtgctcgttgattcatggacgtcatcgtggttatgatgattgtaatgagcatgatcatggttgtgatagcgataatgatattgataacggggatgaatcaaaagacccaaaccaatgctgagtaatacggcagcccctaaaattgtccatggtacgagcttagtgattccaagtggttgcgcatagatcatggttaagaatgcgatagcgaagacgacgcccggcatattcaagtaacgaaggctactaattaaagccgcaactagaatcaatgttaacaagagactccagatgctgacgtggagcgtgaagagaccgagttgactaacgataagaacaacggcgctggcaattaagaagacgggccaaaaccaatttttatgcatttataacaatcctttctgttcaagacttattttgagttggcgatagtagcgtcttgaagcgtacagttgtttaggtgagtggtgaaacgcaatcaagttcccggtcaatgtcttggtcaaggaatagacttgtttggtattgacaatggcagatttggagacgcgaagaaagtaagcaggtaagcctgtgcccacagcggtcagcgacttgggaacacgataaacattatccagcgtatgggcggcgacctggtgaccagttgcttcgatgaataggatcgaagtaagtggtaactgtacgagttgaccacgttgtgaaacggttaacgtagcggcctcaattgaaagatttttgagagcagcagtgagggcggccgtttcggggtagtcgactggaacatgcagtgtgacggttggaattgaggtgtcgggatccgtttcaatgttcacttgcatgggtttcacctccttaagtagcttaagtacaccacaaaacaatgacgctgtaaataaggactcccttagcggtcatttcaggaacgcaactggtcattggcttgctcatcgactgtcaatgttgcgttttatcggcaaaaagggcacaattactgtaaacgatttcaatgatgaggtgttagtaatgaaaataacaattacagatttggccagtaagtggtttcatgatgacatgggtgtaaccactggtaatggggtgcgcttttacggcaaaacttatggcaagacagccgttcacagtggcttctcaatcggaatcatgcgtgatgacgaaccccatcaaccgattgccatggttgaaaaggatggtgtcaattattatgtcaacgaccgtgatgaatggttctttaagggctatgatctcacagttgattatgatgaacaaaatgacggtccgaagtatgactacacgcctaataacgagtagttctggtgagtgcttgccaatagcgattaatatttggacaaaaaatcagcgtcgcctgaattaataattcaggtaacgctgatttttgctgaccacatctttgagtgtgaaccgggctaggcgtggtggcgtcgacgccggacgataaaccaaccagccgttgcgagggcactaatcccagtaatcagactaccagtgattaagaatggcggtcgatacgtcaaggtgaccgtatgcttgcccttacttaatgggacagcaacaaaggtattaatcactttcttagttgcgacggatttgccatcaacagtggcatgccaacctttggagtaaggaatggtcgtcatcaaaacttggtgacgatgcttgatgttgattgtaccagtaatcttacgacttgagtgggccgtaatgttccaaggggattgctggagtttctgcgccgacttcttgaattgggtattatccaacttgtagagggtgaagttttgtaaccagagagaagtcttcttcatctgaatcccgaaggttacggtcttgcccttgctattcgatgcaacgttaacagcgatcgtgtgccggtaagttgggtactgcttgagttccttaccgttaatgtagtaactcgcattcgaagtagttaggttttgcccgagcgtgatgtagtaggaatcattggttgtcggcgtgaacttaaagtaaaccgaccccgttttcgctaaattttgtttgttcaagacggcgccagttaacgtcgtgaccttcttaacgttttggaagaccacttcgttaaagttttcggcactgatcaagccgctggttgaacgatttgccaaggtttggtaaatcaactcttgccgggcaatcggatcgccagttgttttggagactttcaagctagtaatcttgtcagacgctgcgaaaccaagacccagggcgtatggatttttgtaggtcgtgactttgtgagtgctgagcttggccgatttttggtaattcgtcagatctttcttggtactggtgaccggaacatagctacgatagttcgcgttatcagtctgggatgtcgggactgttttgtccataaagtactgcatgtccagtaacgaatcggtaatcatggtcccgttggtgtaggcgaccacaccgtccccatccggctgaccaattgaaccgaaaaagttagggataatactttcgaaggtcgaactgaaatggtcagcaccgttataggccgcctgcatcggatcgtctttagttcgtgtaaacgtcttaccaattcgataaaaacgattgttgctagctttaattttgttgacggcattgtcaagggcttgcgtgtatttaccaaactcactttgtgacacgtaggaaatattatttaatgaagcgaccacgttgattgacatatcagtcgcaactaaaattaacgcgacgatttgataaatgagacgtcgttccttaggcaacgttaagaaaatcaatgtaattgctgccaagccaattgtaattaagagattagcttgggtgacgtaggtgactttcttaatgttcaagtaaatggttgtaaacaaaccgaccagcaatgcgagcatcgttagcgcttgccacagtttgatcgttattttgtctgtcagtgcttgggcaccaatccagacgacccagaaacaaaagacaaaggagaagcggtaagggtaccaaactggaaattggcccgcatgccacaataaatcaagtggttcgtaacaaaatgataagataagcgtcgcggttacaatcaaggcgctcaacttcacggaccatttgaactggtgccgtaagaagaagagcacaaaggcgagaactgctaaccatgccacgtaaaagttcggttggccggatggcatctgatcgaagttgaaagtaccggtgacgaacttagctaacatcttccagggcgcgtattcaagtttccaatgaaccttggtcacattatattgagccttactttgaatgagcgcccagaaagttggtaatagcaaccatgcggagaatgcgacacctagcagaccaccccaagcaaatttgagggcgtgagttgctaaggtcttcacgttttgccaatacttagttgcgccatacaaccagtataaacaactgaataaaatgaccatgtagcccatataatagttgtcaattagcatgacggccagccagccagcgaagtaacggactttaccagttgtaaacaagcgttccagtcccaaaatgaccaatggtaaaatggcgaccgtgtctaaccagatcatgttgagctgattggcgaccatccagcccatcagtgcgtatgcggtactgaaagttggcaccagccaacccttttgcgtctgcgttttagtgagtagccaggcgaaggatagccctgcgaaaccatactttagtacagtgacgataaaaatgccggtagtgattgattgaccagggaacagtaagtagattaaattaaagggactcattaagtaataagcccagaccccaaccatctcgccaccaatcgttttggagaaggaatagaagaaagcactcgggtcgtgcagtagggtatgccggaaataggaaaacaaatcaacgtattgttggcctaaatcgaccgttaacagactgcttgatccaaagggagccatgtgccgataaataaaataaccggtcatgatcagtaaaggtaaccaaaagctgatccataatggccacgtgcgcttgtcaaaaaaacgacggagtttcaaaaattgccacctcaatctctaataattcacagccaaacagaaaaataatcaaaaaaacattaaaatccgtaataacggctgaaatttttatgtctatcgtttagaataacataagtatggtatttatctaggattgctagtatcatctggtaaatttttgcgaaatgtttaccaaattaagaatgggagcgcctgagaattgaaattgtttaagaaaattacgataaatcgtgatcccaacaagtcgcatattccatttcggctgaacttcttgtttttcatcgtcttcttgttatttgctgcgttgattgcgcagttagcttacttacaagttgattacggacagaagtttcgaagtacggtgaattcggccaataatacgacggcaacgggaaacgttcaacggggatcgatttatgattcaaccggtcgggtcttagtgggaaacaaatctcaccaagcgattcaatacacgaaggggctgtcagttgcgtcgactaagatgtatgaagtggcgaataagttaggtgaatacttaactattccaacggatacattaacggatcggaacttggctgattattacttagcgggggcggctaatttaaagtcggttgctaagaaggtcaaaacgtctagcgacgatgatgttttgtacgcacgggaagtcgcctatgcggaaaaacatatcattaatagtttaacgtctacgcaaaagaatgcggcggcgatttattataagatgagttcggcgtactcgctgtcaacggtcaatatcaaatcgactggtgtgacgagtacggagcttgctgaaatcggtgaacaccaatctgaaatgccaggagttaaggtcggaacgagttggactcggagttatcctaatgggaccgacttgagtagtgtgctcgggacagttaccactgaaaagcaagggttaccgagtgatagcattaaaaccctgctggcagaaggctattctcgtgatgattcggttggtcaaagccaattggaaaagcagtacgaaaatgtcctgcgtggaaccaagtcgcagactgaggtcaagacgcaggatggggtcattcaaaaggaaatcaagaagtacggcggtcagaagggtgacaacgttcagctgacgattaactcgaagttccagaaaaaggttcaaagcatcattatgtctgaagccaaaacggtggggagtagcaatgcctactcgccaggagcctatgctgttgtaatgaaccctagcactggtgccatttatgcgttagcaggtgccagccggaatctatccactggtaaagtgactgaaaatgcgttaggaaccatcaaccaatccttcgttatgggctcggtcgttaagggtgccacggtcatgggtgccttgcaagatggtgtgattacacccacgaatagtactttgaccgatacgccgatcaagttagccggaacggccaccaagtcgtcatggtttaacaagaatggtggaactagtctgagtcttaacgcttcgactgccatggaagtttcttctaactcctatatgatgcaattagccatgaaggaaggtaacttcagctatgcgtctgggaaagccttgacgatgtctaattcggtcttctctaaacttcgtggttactttaacgagtttggtttaggtgttaagactgggatcgacttgccgggtgaagcctcaggttaccaaggttcttcggcacagaaggatattggtaaagcgttagacttgtcctacgggaactacgatgcttacacgactattcagttggcgcaatacattgcgacaatggcgaatggtgggcaacgcattgcaccacacatcgtttccgccattactggaactaaatctaatgggtcccaaggggccgttaagactaatgttaagccacgtgtcctgaataccattgacgtcccatcctcatactttgatgtcgtacaccaaggatattgggatgtggtccatgggagtatgacgcagcggacggggagtgcactagctagtttatcaccagcggttgcagctaagtctgggactgccgagacattccacggaacgacatctactgaaacgttgagtttggtgacttatgcgccttataagaaccctaaggtagtgatagcggttgcctttccaggaattaccgctactagtggtgattataatatggtcgttgctaagcaaatttatgcggcgttctggaagtattacaacaaataaacaatgatttttgataccagtatcttaattgatactggtattttttaatcattaatggtatagtagttcaagttaagggttccggccctgtaatatgcgaatgagtttggagggtcaacaacatgcgggtacacattacacttgaatgtacagaatgccatgaacgcaactacttatcttcaaagaaccgccggaacaatccggaccgggttgaatttaagaagtattgtccacgggaacacaaagtgacattacatcgtgaaacaaaataacaacggggactcctgttgttttttctgtaacattgtcatcagacaatgggtttctcatttgttggcaactgccaaattgatttttcaatttgacatgttaatgaatgagatttttttataccaattttattttcgggggtgccgtacgtggagaaaaaagcatttcgtaagcaacagcttgggcgattaagccaaatgacgccggctgaccggcaacggcaaaaccaggcgttacagacccaattatttgcaagcccaacatggcaaactgcccaggtcattgccatgacaattagtagtgacatcgaagtagcgacgcgcccactcattgaacaagcgtgggcggagggcaaaatggtggttattcccaaaacgctaccgcatcgtcaaatggccttttatccataccaagtgactgatcgacttgagcgaacgacttttggcatcttagagcccgtcacgggtgaaccagtcgccaagcaacaaatcgatttgattttagttcctggtcttgggtacagccgtgaccggcacgcccggattggatttggtggtggctactacgatcgttacctcgctgattatccgggtaagaagttgacactggcttatgacgagatggcttttgaacacgctgaatggccggttgatcaatatgacgtcttattagacgaactcttggtagcaggggatgaacaacatgatgagaattaaacgctggtggcaaactgaaccggctatcacgcaggtgctacttggaattactgtggcagtcttcttagtcgagtggctgatgggcgacggcgccatgctgatttttaattcactaggtgctaagaacaatcaagcaatcgcggccggccagtggtggcgattggtgacaccgatgtttttacatatgggacttactcatatagcactgaatggtgtcgttatttattttatgggcatgcaaattgaagcgatgtatggccattggcggatgctggcaatttatattttgggtggcattagtggtaacattatgagcttcgcgttatccaataatcagtcagtaggggccagtacggcgtgtttcgcactctttggtgcctttttgacgattggggaatcgttctgggaaaatccagtgattcgccagctcacgaaccaatttttactactaaccgttttgaatttagtattcgatatgttctcgaatggcattgatatctggggacatgtcgggggtctagttggtggctttttgttaggctatctgctgggtgtaccacgaattggcaagattgcgccgctgaaacgaattgtggcaatggttattctagtcattggctggttagctttactaaaaatgggttttacaaatgctaatttaactgtataattaatcgaggatatgcacatgaaaacactttacgacgtccaacaattacttaaaaaatttggcgtgtacgtgtacgtaggcaagcgaatttgggatattgagttaatggccattgagatcgatcatctctatcaagctggtgtcattgacccgaagatgtatgcccgcgtcaagctcgtattgagccatgagcaccggatagaagcagaacgcgcccgtgaagacgcggcgcatgactaatggagggatttagcaacatggagcgtaagttaatcggagtcgaccttggtgggacgacaactaagtttgccattttaacagaaaatggtgatattcaacaaaagtggagtattgaaaccacgattttagatgaaggggcccacattgtgcctaacatcatcgattccatcaaccaccacattgagttatataagatggaccgttctcaatttatcggaattggaatggggactcccgggaccgttgatttggataatggtacggttatcggtgcctacaacttaaactggaagaccttacaaccagttaaggctcaaatcgaaaagggaactggtatcaaatttacgctggataacgacgctaacgttgctgcacttggcgaacgttggaagggcgctggcgaaaacggtagtgacgttgtctttgtaacgcttggaactggtgttggtggtgggatcatcgccgatggccgtttactccatggtattgccggtggtgccggtgaaattggtcacgtaacggttgaaccaaacggctacatgtgtacttgtggtaagaaaggttgtttggaacaatacgcttctgcaactggtgtcgttcacgttgctcgcgatatggcagaagaattctctggtgcttctaagttgaaacaattattagacaacggtgaagaaattagttcaaagatcactttcgatttagctaaagaaggcgatgtcttggctaaacgcgttgttgatcgggtttcttattacttaggcttggcattagctaatgtcgggaacacgatgaacccatcttcaatcattatcggtggtggggtttcagctgctggtgatttcttattagatcaagtcatcagttactttaaccaattcacattcccaacgattcgcgacacgactgctttgaagttagcagtcttaggtaacgacgctggtgttatcggagccggttcattggcccaacggtttatttaagtaaaaatcaatcttcaagaagcttggaagtaatgtccgagcttcttttttataccaagtgccacaagctgtgctaatcagttggcgtttaacaactaagcgccaattgccaatattgatttgagctcacgtcctcaggtgatgcgcagttttcgctgcatgtcggcatgttggttgaacggcgtgggaactgctacgcgatttggcacaagggatacggatcgactagcgtgaattgaattagatgacagaattgattggagaagcaggatggtaaagttattattgtcttcacgggcgtttagcactgtggccgtaacggacgcctttttcactttagtggcgccggtggctaagaacagtgcgagaattgtgattattgtcaattcggtcagcacgggtaaaaatcacccccaaatggtggcactacaacaaacggttcagcagcttggatatgcgcacgtgcagctcctagatgtattgacggatgatttggccgcattgaatacggcaacggtcattattttgaatggtggctacgagtttttactgttgaagaatctgcgtgaaacgcacgtgctggaacgactgaggactctcacgctggcgggcaagccaatctacggtattagcgccggggctatcttgttaggcccggatttagacctgtacgcctatttatacccggaggacaacaccgagcaactggcaagcacaacagccatcaatgcgacgacgatccgtatttatccgcattatgatgttcattgtgaagtaaagccgcaattgccgcagttgatcactgactgggaacataagacgggcgttacggtcaaacggttgactaacaatcagggattactggtgcatggtagtcagattcagatgatcgattcagattcataaatgtgataccgcgatgcttggttttgaattaacagcgtggttaaatgcgggtctcaggcccccgaccgttttaatggatttctttaaaccgtgggtgagtacggccataaagcaatcagtgggacttcaggattagtcagcagtttaatcgcggcttttcctgcttacccctagtaaaagtaagcggttttgtgtaaaatagataagtagaaattaggagggataacgtggttttaggtgcattgagcggcatggcgtatgttaacatcgtgttagttatcataatcgcggcctactttatttatgagttgtatagttacattcgacggcgtcaggtgtccacgatgttggacgaagaagcgtttcaggcgggaatgcgtaaggcgcaagtgattgatttgcgtgaaaagaaagagtttgacgctggtcatattctgggggctcggaatattccgttcaacagtttgaaagttcggatgaacgaacttcgcaaggatatgccaatctacgtttacgatcaaacccatacgttaagtacacgggccgtcgtcacattagctaagaatggttattcacagctatacattttaaaacccggttacgcacgttgggaaggtaagacgaaaaaagcgaagtattaaaaaatggcggctagaacaacaacttgttcggccaccattttttatttaattaaccgttgtgagctgagcgactcttgcgcatcgcctttttccggttttcttcgaatttgttttcttggtcttcgattggatcaacaacttgcttcttaaatgataagacggagccaattacggcaccagcagttgcgacgaccccaaacaagaagccacgggtaaatgatttcattagtaaaacctcctagcaattgttagttttattatgcttgttttatgcggagatagcaatcaattcaatctaatttttaaaaaagtggggtgaaacgcaatgcttactcaaattattgctcatcgtggtagcaaggggaccaggccggaaaatacgttaccagcgtttattgcggctatcgcggatggtgcggatggcattgagactgacgtccacttgtcgcgagacgggcaactgattattatgcatgatgagctcgtcgaccgcacgaccaacggcaccggccgaatcgtggatcacacgttggccgagttaaagcaattggacgctggtgttaagtatgcaccggcctatgcggggacgcgtattccaactttagatgaagtggtccaattattgattcaatataactttactggtatttttaatctggaaatcaaaactaataagattcattatgaggggatcgaagacttggtagcggattattttaaccatcatcaagttccgtttacgctaatttattcgagcttctacggaaagtcgatcgaacggttgcatgttttacagcccgaggtcgaatcggatagcctgttcaagactaaggttcaaactgcaaagcgactgcatgcgcaacacattgttctcggttatcatccggatattcgctgggtgcgggttcactggctcttattgccaaaagtacagttgcggccatggacggtcaacacggagcgcgatatgcgattctgttatcggcatcggtttgcagggctgattaccgactaccctggattggcgcgacgagttcgtaaacaggtacaaggaggttaaacgagtgacggcagtaactaaacagaaagtattattaatcgcgggaccgacagcggtcggcaagacggcgttatcgcttgagctagctaaacggctgaatggcgaaattatttcaggggactcaatgcaggtctatcgtgacttagatattggtacggctaaaataatgccggaagagcaagctggcattccacatcacctaatcgatatcaaaaatattgatcagcgttttacggtcgctgaatttgtcagtcgggcgacagcgttgattaccgatatcagtgcacgaggtaagctacccattattgttggtgggactggcttttacttgcagtccttgttggcgggttaccaattcggaccagcggataatgaaccagatatggcttaccgtcaagcttggtttgatcgtgctgctgttgaaggttcggaggtggcgtgggcggcactaaagcagcgtgatccgcaggcggccgccgcaattgcgcccgctaacttggtacgagtcgtgcgggcactggagtacgcccatacaaccggtcagcttttttctgaacaggcggatgcgtccggtaacacgctggatgcttatacgctatgcctgactgcggaacgagcgttgctatatgatcgaatcaatcaacgcgtcgaccagatggtagccgctggattagaacaagaggcccgctggctatttgaccaaggtggcgccatgttaccggccggtaaaggaatcgggtatcacgaatggttcccgtactttgatggtgaacggacgcgtgacgaatcaattgctaagatcaaacaggattcgcgccgttatgcgaaacgccaattgacctggttccgcaacaagatgacggtcgactgggtcgacctattggaacaccctgaattacgggccacgattgaccaacgagtcgctagttggttaagctaaattataaattggtatacctataatgaaacgtgtgatattttctgacatgaatgattgacattcaatgataacattgctaatattaagtctgtattaaagaggagggtcgttatgaaggaaaaggaactccgtcgctcgttggctgtcttgccaattggtacggttatgaagttgaccaatttatctgcacgtcaaattcgctactacgaagagcaagaattgattacaccggagcgaaatgccggtaatcggcgaatgttttcgttgaatgatgttgatcgtttgcttgaaatcaaggattacttagcagatggcatcaacatggctggaatcaaagaaatatatgcgctccaaaagcagcgggctgagcagaagcaagctgacttggctaagccactaactgatcgcgatgtgcgccgaatccttcatgatgaattcctgaatctcggaggcttgcagtccgacaagggccccaattatccggcacactaagatgtttgcatccgttagtcaatcaatttaaggagcgattttcatggcaaaacagtcctactcaaaagacgatattcgccgcatcgtcaaagaagaaaacgttaatttcttacggttaatgtttactgatctattcggcacaattaagaacgttgaagttccagtttcacaactcgacaaactcttggataacaagttgatgtttgacggctcatccatcgatgggtttgttcggatcgaagaaagtgacatgtacctgtatcccgacttatcaacttggttgatcatgccttggaacacggaacatggtaagattgcacggattatctgtgaagtttacacgtctgatcgtaagccgttcgaaggggatccacggaacaacttaattcgtgtcctgaacgatatgcgcgaagcgggttacacggcattcaactgtgggactgagcctgaattcttcttattcaagatgaatgagaagggtgaaccaacgaccgaattgaatgataagggaagttacttcgacttatcaccaatggacttgggtgaaaattgccgccgagacatcgcacttgaacttgaacgactcggctttaatgtcgaagccagccatcatgaagttgcccctggccaacatgaaattgactttaagtatgcggatgcgttatcggcagccgatcatatccaaacattcaaattggtcgttaagaccatcgcgcggaaatacaatttgtgggcaacctttatgcctaagccgttaaacggggtcaatggttctgggatgcacgtgaacatgtccttgttccatgatcaaggtaatgccttttatgatgctaatgataagagcggcttagaattgtcatcagacgcttatcacttcttgggtggtttgatgaagcatgctcgctcatacactgcggttaccaacccaaccgtcaactcatacaaacgtttggttcctggatatgaagcgcctgtttacgtggcttggtcagcatctaaccggtcaccaatgatccggattccaagtgcgcggggcttatcaacgcggcttgaattacggagtgtggacgcctcgacgaacccatatttggcctttgcagcggtccttgaagctggcttggatggcatcaagaatggtatcgaaccaccaaagagtgttgaccgtaacatctacgtcatggatgaagatgaacgggcaacagctggtattgctgacttaccatcaacgttacacaatgcgttgaaagaattccagacggacccaacgatgaaaaaggcgttaggaccacacatttaccagagtttcttggaagctaaacgacttgaatgggcttcataccgtcaacaagttagtgaatgggaacgcgatcagtacatggaattgtactagaccataaattaagataaaaatacgacggttagggcaccttaaatggcgaactagccgtttttgttataaaattggtaaattagtggtgttaacctttattaatgcgctaattttcggtaacattaagaacagcagtgcaattcagcaagttttcaattattattgattgcaaggagattattatggaaaaacaaaatcagcctgatcttgaaaaacaagatcaacctacgcgcgcgcttacgaagcgacttcaacaaaagttagactatgtaactacggtgcgccaagcaattacggctggtgacgaccggttgatctacgaattgatcgatggtgaccactatcaccaagccttacttaacgaggaaccggatccaacccgtaacgcccaagtggatttaattacggatgtctatccggcaatcagtcactacttgagtaccaagttaattgattatttggctcatgagtacccattcttttattatgaagaaacccaactcggcgaatttcagatttactttggtaactggtgggatcggcgccggtttggtaaattgaacgttttgaaagtcgcctttgaatttagttcggaagaatacaataaattacaaaagacgtttgaactggctcccgcgcacaaacgtttcaatacagatcgtattcagcagatctcagctggtagcgatcagctacagaaactgattgacgcgcaatcagaccgtgatgcgcaaaaagaagaattgcggcagcaactaaaggaaaatgggcaacgtaactcactatttgattctggtcggatcaaagaagaacggcagcaaattattgaccagctaactaagttggccgatgaagacgaacaagctaataatgcccatgcaaccatgaaggataacgaagctaagattttaacgctttctaaggaagatacgattttagcttatgagaagcaagcaattgaaaacgcctttaagagttttgagaattttaatgagcgtaaccgtagtctttatgttgactacttgaccacgctgattgggaaggcgcaggtagcggctgatggcgaataatacggacaagcagatggacacggcaacactgagcactcacggtaagctgagtacgttcaatgagggcttaaaaaaaggactcgctaatggtgaaaaatttacggccttgatggaccaactgatcgatacgactgacggggagacgctgttagcagcggcccaacagctagccgattttaagctggatacggcttacgtcacgttcccacaccagtatcagaatgcggattattacttgatcttcatgagccggttattaggcatgcatggtgatgaacaagcagtgttgaattctcaacggcatactgaagcactgtatcacgtttacggagcgctaacggatgattacaccttcttgtatcaaatggtgaacaacggtaacggtggcgcctattatcgtgaacaaacaactggcgaaaacttattttatattcatttagaacggcgcttgttacggtttaatagttcggcgttcacgaatttatttattaataaattattgttgaaggggactggggttgaccaaattaatacggtcctggcaacgctaattaaatttggacattgcttacaagatgattttggctttaacgtcgactttaatattttggacgttgcgaacgcggctaaatatgaactgcggtcggctaatttagatcgggcaatcgttgacaaattgtttgtcagtgcggctaagaatgagcacatgttgcgtaattcacagcaaggacatggtgcccaaattgaactgcgggctggtttgacagttgatatctttgatgcagctgaagctggcggtagtcaacaatgggtcctgactgttcatgatcctgatcaagcagtttcgtggtttgacgtgttgttacactttgggttcatgcgtgattggtacttagaaaatatcgattcgctagaaataaaagcggatccattagtatttgcttaagtaacgggggtattagatgttagaactaacaacgttattacaacagtcgattcgtttagaccgcgatattacggcccgtcaacagattcattggcggccacaagaacggttgcaaaatgcgatggtctcactggacgtcgaattggcagaaatggctaatacgtcggaatggttcaaagtttggaagattcatcgtggcaaagcggatcctgataagacacaccgcgaaacgctgctgaacgaatacgtagatgcgatggacttcttcttccttgtctcagcgattcaacagtggacgcatttgattccagtaacgcctgagcaattgacgacgattgcggctaagccggcgactgatttgaataaacagtacttggcgatcaagcacctcctctatgatgcttactttaaccatcgtcaggagagctaccagcacgcttggcacgttttcttgaagattgggctagttgactttggctttactcaggacgagatacaaacggcgtttacggccaagaatcatgtcaatgagcaacgacaagcgaataactattaaaaaaataacctaattgcgcgatttgatcacgtaattaggttattttttttaaacggctggcattaattgcgcgtcgttatcggtgtcttgcgcaactaagtcgttaacttggtcgatcaatgcttgccgctgatcaaggtcatcgtcgcattcaaagaacgccccgagttcctcagctaaagtatctttgcctgcatccatgtaccgaaagtcattgctggtgatcgtatagtgctggtgatctggcatccgaacgatgacacaaccagtggctgacttccccttggtggctttgtccgtaaactcgaccgcgagtacgtaggggccgtcagtggaacgatccttgattgcgtgggcgatatttccggcaattgcttcaagtttcaatatgtttcacctcaaaacatattatacgcactaataggatgggatgcgagaattgatttagtccatcggttgttcagccagccgatcctgttcagcgtagaaggtgttaaaggcgcggtgggcgctgatgacgaagtggtagtggtgttgtgcgattaataagttattatggaattcaaaggtgtcacgcccttgctgaacaaacgtcaagtaatcgttcagataaatgttactagttaagccatggcgtaaaagcattgttgattcccccaaacatcttagatatgttgattgtactacttcaaggcggtagtaggttgggtcggaaacttgattgtaaattagtgatataaacgatagctgcccaaatctgttgaaacaaaaaagaagtttgctaactgttggttcagcaaacttctttattcagagtcacaactgtgaatcgccagtatgtcacgagtgagacttgaactcacaaccctccgcttagaaggcggatgctctatccagttgagctaccgtgacaacaacaagactaattatagttaagaagctgaaaagtgtcaatttttatttgatttttcaccgatttgtagtgaccgaaaaaggcgtgagcaatcaggatcatgcgagaatgtaatatttgtaatgaaaaagcactgaattaaggtaagtatatttcatcaggacaatggcaattatgatgaaagtcaaaaatgtcgtcagacaggtgagtgggaacattgtttttatggctattaattaccacctgaagaatgacacgatataaaccttgtggtagcgccaactacgtgcagttgcaatttaatttcctcttgcggagctaccgcttttattagtcgtgaagaaaccaatttctcctaaaatacttaagaaaagataaagaaactaacaaaactgacaaaaatggtttgtttcgcttgaaatatttctgtaacaaaacgataataatcatgtaacaaggaaggagaattcttatgggttcagtatttgcaatcgtcggtatcatcgccatcgctggtggcattcaatattattcaaactttgttgccaaagaaaatgcaagcagtaagcatttcactgcttcccgtaatgaccgttagtcaacgggagttcttaacttgcacattggcattatacaatcaatcaattaaaaaagaactgctcattcaagatgagcagttcttttttaattacttgatttttggtgttttttcgatggtgtcagtcttgccggcagcccaacgttggatagcagcaacttctttttcgcgacgaatgcgcttttgcttcccagcaactggccgacgtgatgcccatgtgttatatggttttgcaacaacagtcataagagtatgtccctcctttgattagtccaataacgactatattaaacaagaatagtgtacattgcaaccgaattaacaggaaaagctagagttttcccaaaaattgcattattagtataacggttattttggtcggttgtcaagataaaatcctttacagcactgatcattttaatcattccacttgaaattagaatcactcatcattttggagcggccaatttctttgccgttgaagtagattttagagcgtagaccataggggctttggacaatgttaaacccttgtttggagagttgattgattgaaaattcgcggaataaatttgccagtgctgttttttgcgagttattagcagataagaattcggaagtgacgtgaacgtctagcccagtgtgcttatgaaatgccatatcgtcaatgagttgtaggtaaagatattgttcattattgttggcaagtcgctgttttgttttgagtgcggtggcaagctgggtgttgtattgactcatctgtttagatgacatgctgttaaaatggtcgagtgcagttttggcagtcgtttttgaaaattgggctttattatcatggcttttagcagttgcgtttttcacagcgttgtcagtactttccttggaatcgattttaccgacgatcgtgcccgtgactagcaataaaatgatataagcaaagagccattttgcgagctgccgttttctgagtatcctgggtctggttgtgattctgcattttatccagtagccgatatacccgataatggtcaaagtggcggtcaattgcgttatagacaataataaagacatatgaaattcctccgtgaattagatgacagattgattgaatgctgcatcggatttgagtcgttaagtctcattttatcgaagtgtgtacattcgctcaatctgtatgtaaaagttctaataatcttcagaatatccgtacgtggtagtgctttattaatcgtattttcgaagtgttttaaattaatggttacttagcgaaactattttattagctgcgattatcttagacgtaatccaactatttgtccggctaattatcatctgttagacgctcctggcaattaatgttatattaattatgaaatgaaagtagggagcagatatgagccatgaagttgatccgcgtgtcgataaaactcgtcggcgcttgcgacaagcattaattacattattacagacagaaacagttgataacatttccgtgcaaaaactgactagtacggcggcagtcacccgtggaacattttatctccactataaagacaagccggcgtttgttgatcaggccctagatgacttggtgagtgaattatttgaaacggccatcgtgacggtttcagtgagcgacattatgaccaatccggccgacccattacagcgggtgcacgttttttccttatcaaaggcacttgactacattagtctgcatgcagaagcttttgagacgttattactagaccaacgtcagttagcagtcaatcaacggatcaatcagcagatgacgacctggatgacgaaatttcatcgtgactttcaggatcaatttgctgatctggaagtaccggtcagcattcaaatcgcgtattacgtttctgcgacagtcggcttgattactgattggctagctaatgatatgatctacacgccacattacttaaccaagtgtattaaaaaaatgcaccatttgatgacggtagggagcattagtttcacggacttttttgtgaagtgaaatcattccttgactattttgggaaaatttgataatattttcctgttgtatttgtggacttctacagctacaaccgcacggattgagtcttaagttcagcaatggcacttatattcggcgagtctaagtgatttatattttaaggaggtgcacaaacgtgtacgcaattattgtaactggtggtaaacaatataaagttgaagcaggccaagcaatttacgttgaaaagcttgacgctgctgctggcgacaaggttacttttgatcaagtagtctttgttggtggtgacacaactaaggttggaacgccgactgttgatggtgcgacggttgaaggtactgttgaaaaacaaggccgcgaccgtaaagtggttactttcaagtataaggccaagaagggccaacatactaagaagggtcatcgccaaccatacactaaggtaacgatcgacacaattaatgcataattaagaaagtaggcattccttatgattcaggcaaccatttctcgtaatgcgaccggtcaagtgaccgcttttaaattaacgggacatgctgattcaggtgcttatggacaagacatcgtttgtgcagcggtttcggtgttagcaattagtacaatcaatgggattgaacaagttgcccacttacaacccgtagtacaaagtgatgaaaccaatggtgggctgttaattgcagacttcactaagttggacttagcgaacgcacaattacaaaccttacttgaaagtttcacacttggtttgaacgatgtggccacgaattacggagattacatccgggttcgtgaacaaacacgataaccacattcggaggtggactttactatgttaatgaacttgcaattcttctctcaccataaaggtggcggttcaactgccaacggtcgggattcagctggtcggcgtttaggcgctaagcgggctgacggccaaactgttaagaatggtaacattctttatcgtcaacgcggaacccatatttacccaggtgtaaacgttggccgtggtggcgacgatacattatttgcaatggctgacggtgtcgttcgttttgaacgcaaaggtcgcgacaagcgccaagtatctgtttacccagcaaaataatttttgaagagcctctgcagggaggctctttttttgtgaagcaatccagcaatgctgttaggctcacgactcgtccaaggttgcgatacgctcagtgcacgttgttgatgagtggccttcaataaatcattaccttcagttttgggaaagtttggtataatgaagcgtgaggtaatgatgggagtgacgaaataatgagtcgagttgaacggttacaaaataagtttgatcaattaaaaattgatgcgttcttagtttcaggtggagctaaccttcaatatttaacggggatggctgatatggccggcgatggttatttgctagtgctggcacaggaagcctatctgattacggatgcccgttatcagacagctttcacgaatcagtatgacgaccagcacctagttattacacgtgattatctgggggccgtttgtgagattatcgccaaaactggcactggggtcatgggtttcgaagacgagattccctatgcagcttatagttacctggatgagaacttggtcagcgatttggttgctttaccagacgtggtcgacgaattacgcatcactaagagtgctgatgagattgatcggttacgagcgagtgcacgtttagcggatgctggttttgaatacgtcacgagcattgtgcgaccaggcatgcgcgaaatcgacgtcagcaacctgttggacgcgtttatgcgaacacacggtgcaagtgggccgtcgttcacgacgatcgtgttgggtggtgcccgtgcggccttaccacacgggacagcttcgaacgcggtcttgacagccgggcaactcgtcaccctagactttggttactttttggacgggtacacgtccgatatgacgcgaacgtttgccttaggtactccggacgacaggttagctgcggcctaccaagcggtgcaagccgcccaacaggctgtaatcgatcgggtcaaagctggggcagcgactgctcaactggatgcggtcgggcgtgatttgctgacaaacgcgggctatggcgacgccttcaatcatggtatgggccatggcattggtctcgctattcatgaagggccgttgatttcaaaaaacaccacgggtaccttggttgcaaacagtgtggtcaccgttgaacccggggtatatttcccagatttaggcggaatgcgaatcgaagatgatgtcttagtgaccactgagggccatgaacgactgacgaccgcaacgcgcgatttactgattttatagttaagacagttgccacagcggctcggtcttgttatagttataaagatatatttgaggaggatttttaaaaatgatttcaactgcagattttaaaaatggtttgacgattgaagtagacaacgcaatttggcgcatcgtggaattccagcacgttaagcctggtaagggtggcgcctttgttcgttcaaagcttaagaacttacggaccggtgccgttcaagacaagaccttccgtgccggtgcacggatggaacaagcaccaatcgaaaagagtacgatgcagtacctttatgccgatggcgacagctatgtcttcatgaatactgaaacttatgaacaaatcgaaattcctggcgaccacattcaagacgaattgaagttcttgaaggaaaacatggaagttcaagtaacgctttataagggtgaagtgttgggaattgatttaccaaacacggttactttggaagttgccgaaactgaaccaggaattaagggtgacaccgcttctggtggttctaagccagcaacgttggaaactggtgcgattatccaagtgccattcttcgttaaggccggcgacaagctgatcgttaacaccgttgactccacttacgtttcacgggcttaattttttagaagaactaataccggcaaacatggaattggaggaatgtcaaaatggctgacagtagcaatattacgttacaaagcaaagaacccagcttaggacaaattcaaattgcaccagaagtgcttgaaataatcgttggtatcgcggtaagtcaaattgatggcgttaaccggatgcaagggacgatttcttccagtgtaaatgagttgttcggtcgcaagaagaatcttggtaagggtgtcaagctaacgatcgttgatgatcagatcagtgttgatgtgtacgcatacttggactatggcgtttcagtgccaaaggtcgctttagaaattcaagataagatcaaacaacagattttatttatgaccgatcttgccctgagtgaagtcaacgttcacattactggtatcgtgattgagaagaccgaaagtgccattgatccaaacaacttgtttggtgatgaagatacccagaccgatgaaaatgaagatggtgaagaatcgtgagtttaacgcgtcatgaaatccgggaaaaagcatttcaggctttattcgctttgaatgcgaacccggacgctgatgaaaatcagttattccaacagttactcaaccctgaagaggcggatgcagttgaaattcccgcatatttaagcacgttagtaactggtgttcgtgaacatcaagcggaattagacgcccaaattcagccttatttaagtcaaaagtggtcgttggaccgactggctaagactgatttgattatcttgcgcatcgcgttctttgaattgcaatttgttgacgacgttccaactaaggtcgcggttaatgaagcaattgaattggcaaaggcgttcagtgatgaccgctctcggaaattcgttagcggggtacttggtaaagtggttaaaaaccaggccaattagtctaaaaccgaacaatcttatgttctaccgtaaaagtctggcgatttgccagactttttttaataacttattagtaaaccggtcataaatcatcgtggtgaatatgctaaaataagaccagacagagaaagaggagtgtggcacttgtgacgaagattattgatggtaaggcggtagctaaaaaagttaacgcgcagacagcaacggcagtagcggaattggctgctcaagggattcaaccagggattgctgtgattattgttggggacgatgcagccagtcaaatctatgttcgaaataaaaatcgcaaagccactaagttggggatgcactccgtggtacggcaattaccagcgaccactagtcaggatgaactgttagccatcattgcggcatacaatgcggatgacagcattcatggtattttggtgcagtcgccattgccaactcaaattaatgaaccattgattacgatggccattgaccctaaaaaggacgtcgatggttttcacccgacgaacgttggtaagctgatcactaactttccgggcaattatcctgtggcgaacacgcctcgtggtattatgacgatgttggccgaatatggggttgatccggccggcaagacggcggtcgttattggtcggagcaccattgttggtaagccgatggccgcattattgacaaatgccaatgcgaccgtgacgattgcacatagcaaaacagccgatttaaaggcagttgcccggacggcggatatcttggtggttgcaactgggattgcacacctgatcactggtgctgatatcaaaccaggcgcgacggtcattgatgttggcatggatcgtgatgaaaatggtaaactagtgggtgacgtcgattttgattctgctcaaggcatcgcagggttgattacgcccgttcctggtggtgtgggtccaatgacgattgccaccttgatgcagacagcggtggaacttgcaaagtggagtgatgtaagtgagtgaaagtcaacaatatttgacagtgacagctttaactcagtatttaaaacgtaaatttgaggttgatccgtatttgggcaaagtgtaccttacgggggaagtttctaattatcgtccccggccgaatacgcatcaatattttagtttgaaagatgaccatgccaagatttcggccattatgttcaagtcggcatttgctaaggtcaaatttcagcctgaagaaggtatgaaggtgctggtcgtgggtcggatcagcctgtatgagcccagcggtagttatcaaatctatgtagaacgcatggaacccgacggcgtgggtgccttgtaccaggcttacgaacaacttaaaaagaaattagcggctgagggcttgtttagtgcgcccaaaaagccgcttccacgctttccaaagcgaattgccgtggtgactagtcgcagtggcgcggtgattcgtgatattatcacgactacccggcgtcgttttccgattgcacaaatcgttttgtttccgtcacaggttcaaggtgatgccgcggcggccgaaatcagtcgccagatcgaacgcgccaatgcgcaaggcaattttgatactttaattatcgggcgtgggggtggctcaatcgaggacctgtggccatttaacgaagaagtcgtcgcacgcgcgattgcacagagtcaactgccagttatttcatccgtgggacatgaaacggatacgacaattgctgacttggtcgcagatgtgcgggcggccaccccaactgcggctgccgaattagcggtaccagtatataacgatgttttattacaattaaagcaagaccagacccgcgtgttcaatgcatttcagaatttcgttcaacgcgatcgacaacgacttaataaattacaaacgtcgtacgtgtttactcagccgaaccgcttgtacgaagggtatttgcagaagttagacttcttaaatgagcgacttaaacaggctggtcaaaataactttaatctggcaagccagcactaccagcgtgtttttcaacaattacgacagcaaacgccgattcaccaagttcgccaggcacaaacacaactgcttaacttgcagcaacggctgaatcggggtacccagttagtcgtgcggcagaaacggcaacaactgacgcagaccgtccaatcgttggatctacttagtccgcttaaaatcatgacgcgtggttacgcctttgtgacggcggatgaacaagtggttcacggggtcaaacaattgcagccagaacaaacggttgcaattcacatggctgacggtgaggcgcaagcacagattacgaagatcgatggaggaaaataatggctgaacaaccaacttttgaacagaatttatcacaattagagacgatcgttaatcaattagaacaaggcgatgtccctttagaacaagccttggatcaatttcaaaagggcgtggcacttagcaagcagttgcaagcaacccttgaaggtgctgaaaagacgctcactaagatgatgaatgaaaatggcgacgaagttccgtttgagcaagctgacgccaatgaataagcaattattaactgaatttgaatccaagtggcgtcctcagattaatcagtatttagatgagcagctccaagcgtgttctgaccaaccgaccctgactgacgccatgcgttattcggtactagcaggtggcaagcggttacggccgttattgacgttagctattttagatacttttgatatcgtaacgacggctgcaaacttgcgggcaagtgtggccgttgagttgatgcatacttattcgctaattcacgatgatttaccggcgatggataatgatcaactacgacgtggcgaaccgactaaccatgttaagtttggggaagacgttgccattcttgcaggggatgccttacaaccgttgactttcgaatggattgcggatagtgggttaccggcatcgatcgttgctgatcaaaccttagcattagcgcaggccaccggacctcgcgggatggtggctggtcaaattgctgatgtcctgggagcgggacaacatttggccttaccagccttacaacagctgcatcgcgagaagacgggggcgttaattcactacgctgtccaagcagggttgattcaagctcaagtgcaaccagccgtgcaggaattgctattacaatatgctgatgcctatggattagcgtttcaaatttacgatgatattttagacgtgacgagtacgcctgctcagttaggaaaagctacgcataaggatgccgatgagcataagaatacgtatccaggtttgctggggcttgcaggcgcacgaacagcgttagaacaagctgtaacagctgctcaaacggcgttggtaaaagctagtgctgctagtcaacgagacatgggcttgcttgcagcttttctaacgtattttacagattaaggacttaaatttagatggaaaaagaacgagttgacgtattattagtacaacaaggattatttgatacccgcgaaaaggctaagcgtgccgtaatggccggtgaaatcttaggtgtcaacgaagaacgcttagataagccgggcatgaagatcccagtggcaactgaattacatttgaaaggcaaaccgatgccctacgtttcacgtggcggtctcaaacttgaaaaagcactcaaaagttttgaaattgacgtgaccgacaaaacggtcctagatattggctcgtcgactggtggttttaccgacgtggttttacaaaatggggcaaaaatgagttacgccttggatgtcggtagtaatcagttggtctggaagttacgccaagatccgcgcgtggttgtgatggaacatactaactttcggtatagtaagctggcagatttcacgcaggggcaacctaacttcgcgtccatcgacgtttcatttatctcgctacacttgattttgcccccattacacgcgattattgaaaacggtggttcagtcgttgctctaatcaaaccacaatttgaggctggtcgtgagaatgtcggcaaacacggaattgtccgtgatccggccgttcaccaggcggtgttgacagatatcgtggaatttgcgcaagcgaatggttataacgttctagggcttgattattcaccaatcaagggtggtgaagggaatattgagtttctaattcatctacaagctaccgatgaaacaccacggattgcgccgactgtgtcgattgaaaaaactcaggcggccgcttatgaacaattaaatcaagcttaaaattgaaatccggactttcatatttatgcattttggcttatgatgtgtttaaataagtatgaatagctaccgggggtgatcgggtgaagaagcaagagcgccaacgctacattaaacgattattgagttcgaacgaaattgaacgtcaagaagactttgtcaagctgttacgtgctgaggatattgacgtgacacaggcaacgatttcgcgcgatattaaagatatgcagctggtcaaggttccctcggcaacgggcggttaccactatagtatgccagttcagaaacaaatggatacggagaaaaagctcaagcggacgctgaaagacgcttatgtctcgtatgcgacccaggacaagttcgtccttatcaaggtgctacctggtaatgggccggccctggcaacgttgattgaagcgatgcattatgatgaaatttttggaacgctgggtgatgatgccaacgtcctgattatttgcaaatcgttagcgatgactttagagctacaacaaaaaattcaacgcttactgagtgatcactaagcagtaagctatcttcgacctgttcacacctgtgtcaggtcgctttttttcaaaattaacggatgctggtaaccagttgcttttaaggagggctttcggtgttacaagaattatcaattacgaactttgcaattatcgaacacttagacattgcttttgaagccggcatgacggttttaactggtgagactggtgccggtaagtcgattattattgatgcagtcggtctattagctggtggtcgtggttcggcagagtttattcggaccggtgcggacaaggccgttttgcaaggcatgtttattttgccggcagatggtgtgacggctcaattgttagatgaagcgggaatcgagcacgcggataataccgttatcctacaacgtgaaatcactaaaagtggtcggaatacgtgtcgtatcaatgggatgctggtcaatacgacgaccttgaaacagattggcgaaacgatcgttgatattcatggtcagaatgaacatcaggagttgatgcagcccgaaaagcacttgggattactggatgaatttgccaccgccaaaatccgtaaattaaagcagcggtaccagcaacagtatgatcgctatcagcagttgaaccgtgaattacggcaaaaaaatgcgaacgaaaaagagtgggcccaacgcttagatatgctgaactttcaagtagatgagattgccgccgcacaagtcaaggtgggcgaagaggctagcttgactgcggaacgcgaccgtttagataattaccaaatgatcaatcaagcacttcaacagagttacacgttgttagcggcgggtgaagaaacgactggtgcggttgacatggtcggcacagcgatgaatgccctcgaaccgattgccaatttggaccctgcttttaatgaaattacggttaacgtcaaaaatgctttttatggactacaggacgcggccggtcagatttctaaccagctcgatttacaagaattcgatgagggacgcttggatgaaatcgaacaacgattagatgtcttggcccagttaaaacgtaagtacggggactccgagcaacaaatcttagattactatcaaaaaatcgcggctgagttagctaagatgactgactcggaagaaaacagtgaggacctagcgcaacgggtcgccgacctaaaacaggaactgctcacgactggtgaagcgttgtctgacaaacggcgagccgcggcgaaagtgttacaacgacagatccatcaagaactcaaagatctatatatggataaggcaatctttgaagtgcgattcaaaccgacgaagggtcagatttaccggagtggtctggacagtgttgaattttatattcagaccaatcctggtgaacggatgcggccgttggcaaaaattgcgtctggtggggaactttcacggatgatgttagcattgaaaacaattttttctgaatcgcaaggaatcaccagtatcatttttgacgaagttgatacgggtgtcagcggtcgggtggctcaagcaattgctgagaagatcaacggtattgcacacttttcacaagtgctctgtatcacccacctgccacaggttgcagcgatgagtgatcaccattatttcatcgctaagaagatcactggtaagcgtaccaaaacgagtgtgaccaagttggataacgcggcccgtgttcaagaactggcgcgcatgctggcaggtactaaagtcactaagttatcgcttgagcatgctgaagagttactgcgactggctgatgaagaaaaggacgattaagcttaattgatcgacaccacaagggacggacaagatggtcggtccttttttgatagtgtgaattagtgacgatcgtagttagttcggttacggtatcattgccaaaacgacaataattatttacaatatagggcgcaaataggtgcaataaggtgcaatttagtcgacaggcaaactttaatgagctgcgggactgctgatagtgggtgcttggaagtgccgactagggaaatatgctcgtcagaaggataaaatattcagtttacatgtcatgacgtttgcattttgctttcgttataagttatgcttaattacagtacagtttattcggcaacgaaataaactgagtaaatgattggagtgatgaggttgtttctgacaatggaacatttgaataaaacgtatcctggtggcaaagttgccgttgaagattttaatttggaaatcgaaaaaggtgaatttgtttgtttcatcgggacgtccggttcaggtaaaacgaccacgatgcggatgattaatcggatgttaagtcagacttccggtaccattaaacttaatggtaaggatattagccagattgacccggttaaattacggcgacaaatcggttatgtgattcaaaatattgggctaatgccccatatgacgattcgagacaatatcactttggtaccacgattgctaaagtggccccaagataaaatgaatgaacgtgctaagaagatgatcaaactggtggaattgccagaagattacttggatcggtacccgtcggagctttccggtgggcaacaacaacggatcggggttgttcgggcgttagcagcagaccaagatttagtattgatggatgaaccatttggggcgttagacccgattacccgtgaatctttgcaagatctcgttaaggatttgcaggaacgcttaggtaagacgttcgtctttgtaacccatgatatggatgaggcgttaaaattagcgacccgaatcgtaatcatggatggtggcgacattatgcaagtggatacgccagacggtatcttacgtcatccagctaatgaattcgttgagaacttaattggtaaggatcgtttgattcaagcacggccaagtattaccactgttgggcaagtgatgttgaaagacccaattgccactacacctgggaagtcattgacggttgccttacgacaaatgcatgacaagcgggttgactccttgctcgttactgacgaagcgggtatcttgaagggggtaatcggcattgaagatgttgattataacttcaactcggcgactagtgtgggcgacattatgaagactgatttgttctatgttcagtcagattcattgattcgtgatacggtcgaacgtatcttgaaacgtggcttgaagaatattccggtcgtggatgaacaacatcgtctggtcggaatcgtaacgcgggccaccctggttgatattgtttatgatgccctctggggtgatgaagacgaagatgaagctgaaaacaatattcatcatggggaggacgatgcgcccgctgaaggcggtgaacaggcatgataactttcctacaaaactacggcatgcagttgctggtcaagacgtggcaacacttgtatatttcggcgttctcactgttcttaggcattatcgtagcggttccgattggaattttgttgacgcgggtgaagccgattgcgaatgtggtcatgtcaatcgctagtatgttacaaacgattccagcgatggcgctgttggcactgatgatcccgtttttcgggattggtgcgattccagccatcattgcgctgttcatctattctttattaccgattctccgcaatacctatctgggactggaagatgttgatccagccttgattgatgcggctaagggaatgggaatgaccggttggcagtcaattgttaaagttgagttaccgatggcagccccagttattatggctggtattcgattatccgcaacgtacgttatcgcctgggccgcattagcatcatatattggtgccggtggccttggggactttatctttaatgggttaaacctctatcggactgacttgattttaggtggttcgattccggtgattatcttagccctcatcgttgattggctgttgggtaagctagaagcagcggttaccccaagaaccacacaagcgtaagggggattagagatgaagaaaattaaaaagtggttgttaggtgttttcgcaacggttgccagtgcgttattactagctggctgtggttttccgggattatcaggaacttcatccgatacgatccggattgcgtcacaaaacacgactgaacaacaaatcatggcgtacatgattcaagatatgattaagcattattctaatttgaatacgacaatcattaacaatttaggttctgggacggttagtttcaatgccttaaaaaatgaccaggctgatatttcggcgattcgctacaccgggacggacttaacaacgattctgggtgaaaagatggatcggagtaatatcaagtcgattgaccagaaggtgcgctcacagttcaacagcaagtatcaaatgacctatttcccaagttatgggttcgcagatacctatgcttttatggtgacgaaagcgacggccaaaaaatatcatctaaatacggttagtgatatgaaaaaagtagcctcgaagctgacggttggtttggatcaaatctggactgaacgaaagggtgacgggtatccggcttttcaaaagctgtacggttttcaatttggaaagacttatccaatgcaaattggtttagtttatgatgctttggaatcgggtaaaatggatgccatcctcggctactcgacagatggccggattggtagttatgatctgaagattttaaaggatgataagaatttcttcccaccatataatgcgagtgcggttgcaacgaacaagatcttgaaagcacatccgaagttgaagccaatcttgaatcgattaaacggtaaaatcagcttaaagacgatgcaaaacttaaactatcaagttgataataacttagtggaaccggaagttgtggctaaacagttccttgaaaaacataattactttgaagggagtgacaaataatggctcagatgaacttactgcaacagttgatatactattaccaacaaaacggtgtgtacgtgttaagccagttctcacgtcacttcttgatttcaatttatggcgtgctgtttgcggcaattgttgggattccaattggtattttcattgcccatcatagtcgattgagtgcaacagtgattgcgattgccaatgtgattcaaacgattccgtcactagcgatgttatcaatcatcatgattggtttagggctaggtgtgaacacggtcattgttacggtcttcttgtacgcattgttaccaattatcaagaatacctatactgggatgcaaaatgtgagtgctagtattttggattccggtaaggggatggggatgacccgctggcaattactacgaatggtagaattgccactgtcactttccgtcattatggctggacttcggaacgcattagtgttagctatcgggattacagccatcgggaccttcgttggtgccggcggtttaggggacatcattattcgtgggaccaatgctacgaatggtggtgccattatcttggccggggcgttaccaacagccttaatggcaattattgctgatacggtcttggcttggattgaaaagcgtgctgatccaactcaaaaataacgtcagcgagcgacaagtaaaagaagcaatataaaaattaagttactaaaaaagattgatttacaggtactccgtactcactcattcagggaagtcagtggagctgtaacatcaatctttttgatttgcatcaaaaacaccatgagaatacgcaaggttgtattgaacatgatttcatcttttgatgcaagtattaatgattaaattaaacgcgtttgatataacggatggcgtctggatcgaccaagtgggtcaggtgtaattgccgattaactaaaaccaactgaccactagcaagggtttttaacaccccatgaatattatatggttgcgactcagtaagctgaggttgcatctggagcatgatttgatagtgttctgtgcgtgcttgtgctaagaacaaatcccgctggaaagccggtatcattggcagtaatggcgcaacgacggtcggggcagcagtaaagtcatccataaattggcgataggaagcgtgtaagttcttggaaattagtttcaaattagattgttgattttgcatattagccacctcgaacatttgtttgtgtttccattatacgaacaggcgttctaaaaagcaagcttaaaattcgagaaaatttacgcgcaaaaatgaaaaaaagctgtgtaaccttgataatacttgcaatatagggttaaaaagtgcaaaataaactttaaaacatattttaattaaggggaatttgtgatcatggcgaaacaaggcatgttaatcgtcttatcaggtccttcgggtgtcggtaaaggtaccgtccgcaaggaaatctttgactcagatgataacgattttcaatattcagtctcgatgacgacgcgacagatgcgtccgggcgaagtagatggcaaggactactattttgtgtccaaagaagagttcgaggatgaaattaagagcggcggtatgcttgaatatgccaagtatgttgacaattactatggaacgcccttaaaatatattaagcagtcgttggcagctggcaaagacgttttcttagaaattgaagttaacggggctatgcaagtccgtgaaaaaatgccggatggcgtgttcattttcttgacgccgccggatttgatggaattgaagcaccgcattattggtcgtgggactgatgatatgagtgtgatcaacaagcggatggcaaaagcggtcgacgaaatcaagatgatgcgtaattatgattatgcggttattaatgatgaagttccgctagctgctgaacgaatcaaggctattattcgtagtgaacggtttagtgttaaacgggtcatgcccgagtatgaagaaatgttaggagatgcggaatcatgatcttatatccatcagttgatgacttattgaagcaagttaattcacgttactcattgattatgttagctagcaagcgggcccatgaactggacgctggtgcagcaccaatgcttagcgaatacaaatcggtgaaaacgattggtcgggccatggaagaaattgcggccggtgacttaatgatcgatccagatgaaactgacaaagattagtaacaaaacggtgtgctgagccagctggggcttggcactttttttatgaagaatgacgcggacgttcagcttcacgttactgttgattcttgatacaattgttttattaaagtgtaaaaatcccgctggcacggttgcgagatttttcaaaggacgtgaagaagtgagtatatggacaaaacgccatgtaacggtagtcgttagtggtgggattgcgagttataaagcgttagtattgattcgtggtttgatgaaacagggtgccgtcgtgcgagtcgcaatgacgacccatgcggcaaagtttatcacgccactgacatttcaaacgttaacacagcagccagtggtcattgatgaatttacaacgactgacccgcattacgtcgtccacgtcgaattagctgactggacagaagtgatgattctcgttccggctaccgccaacttgattgccaaggtggctaacggtctcgcagatgatgccgctacgacgacaattttagcgacgaccgcacccaagtttgtggtgccggcaatgaattcacatatgtatgctaatccagcgactcagcgtaacttgcagcagttgacggcggatggcttacacgttttaactcccgcgacgggcatgttagcagagggttaccctggtcaagggcgcttgccggaaccagcggtgattttggcttggctgacagatctattgattcagctgacacctgatttaccattagcggggcggcgagtcgtcgtcacggcgggaggaacccgtgaagccctagatccagtgcgctttatcacgaatcgttcatcgggaaagatggggtatgccgttgctaaagttgcacgggagttaggtgcaacagtgacattgatcagcgccacgactcatttagcagcgcccagtggtgttaaggttgtgccggtcgattcggctcaatccttattgacggcagtcagtgatgtttttgatgatacggatatcttggttatggcggccgccgtgtccgattatcggccggctgaatttgctgatcagaagattaaaaagccagctgaccatgctgacttaacgttacgattgacagaaacaccggatattttaaaaacgttagcggcccggaagcaccaacagtatgtgattggttttgcagctgaaacgcaatcattgctggccaatgctaatcgtaagttaactagtaaaaaattagatttaattgttgctaacgatgtttccaaaccgggagttgggttcaatggtgatactaatcaggtcacactgttgcggcctgagcaacaaccagttacgacggaattgacaacgaaaactgcgattgccaaacagatcttgatgacggcaattgcggatggtgcaggaacacaggcatgattaagtagagaggaagagttgtgtggcacaaattgcccaagtattagtcgatgtgcccactatgcagacaaatcgaccttatagttatcgaattccgaccgcctggcaatcacaagtgcaacctggcatgcgcgtcgtggtgccgttcggccgtggtaaacggcgcgtgcaagggtttgtattggcgcttgatgacgttaccaactttgatggtgagctgaagccaattgacgcggtcgttgacctagcaccggttctgaatactgaagccctagcattgaccaagtggttggcagccagcacgttttcatttcagattacctgtgcacagactatgctgccggcggtcatgcgtgcaaagtatgaaaaacagttgcgaacaacagcaacaacgcccgcgacgattcgaacgacgttgtttggggaccaatcgatggtgccgtttgatgacgtcgccacgacgccggcaatcgtcagccagttattacggctgcaggcggctgggcaagtcgatgtgtactaccaagttaaaaatcaagcacggcgtaaaacgcaaacggcggtgaaagcggccttaactaacgaagcgctaaaggctgcagtgggccaggtacgcgccggggctacacaacaattggcagtgctccaggggttgctcactttaaatggtgaacagctctctcaaaaggcgttttgtactcgttttgatgtcacggacggtgccattcgtacagcagtacagaaaggctggcttaaaaaagtggccgtcgaggtttatcgtgatccatacgcagctagtgatattaaagctaccaaggcgttacaattgaatgatgaacagcaagtggccgtcgatcagattacgcaagctgttgaccaagccgcaaccaccacgttcttgttagagggtgtgacggggagcggtaagactgaggtgtacttgcaatcgatggcagccgcattggcgcaaggtaaaacggcgttgatgttagtgccggagatttcactgacaccccaaatggttcaacgcgtgaaggggcgctttggtaaagctgttgccgttttgcacagtggattgtccagtggtgagaagtatgatgagtggcggcgaatccaacgaggtgaggctcaggtggtggttggcgcacgctcggcggtgtttgccccgctaaaaaatcttggcttaatcgtgatggatgaagaacatgagagcacgtataagcaggatgatgccccgcgttatcatgctcggcaagtggctttatggcgtagtcgttatcataactgtccagtcgtactgggctcggcgaccccatctttagaaacgcgtgcccgcgcagaaaagggcgtttatcagcgcttactgcttgcggatcgggtcaatcgacggccccttcctaaggtttcaattattgatatgaaaaaggaaatgcaacaacacgctgaaagcaatttttcagcaccactgttagttgccttgcaggatcggcttgaacgtcatgagcagagtgttctaatgctcaatcggcggggctattcatcgtttgtgttgtgccgagattgtggttttgtcttgaagtgtcctaattgtgatatttcactcacgctccacatggatacgcacacgatgaagtgccattactgcggtcacgaagaagccattccgcggagctgtccgaactgtcatagtcgtcagatccgttattatgggacgggaactgaaaaagtcgaagaagaattgcaagatttgcttccagacgctaacattattcggatggacaatgatacgacccgcaaaaagggcgcccatgccaagcttttagcacagtttgggagtggagaagccgatattttgattggcacccagatgattgcgaaggggttggattttcctaacgtgaccttggtcggtgtcttgaatgccgatacggccctaggattgccggattttcgcgccagtgaacggaccttccaactattaacccaggtgagtggtcgagctggacgggcggaaaagagtgggcacgtgtatattcagacatttaacccggatcattacgcgattcgcttcgcacagcaccatgattacgaaggctttttcaagtatgagatgcagatgcggcaccggggtggctatccaccgtactactttacggttcaaatcacggcgagtgacttagatgaagcggtagcggccaagcgcatgtatcagctactgcaatggttacgcccacggttggcaccgtcaacgattctattaggcccaacgcccaagccgatcgcacgcgtcaatcgccgttattattatcaaatcgtgatcaaatataaacaagaacccaatttagcgcagacgctgacaacgctactgcatgagacgcaggcgcaacaacgacaagggctacagattggaattgacgtggaacccttacatttcatgtaacgggattaggaggaagtttgacaatgacatcaatcgtttttatgggaacgcccgcgtttgcggcaccgattctcgaaagtttaattaaagaacaataccaagtactgggtgtcgtaactcagccagaccgaaaagttggtcgcaaacacgttttaacggcttcgccagttaaagaagttgcggttgcccatgatattcccgtgtttcaaccggaaaagatcggtggtagtcttgaaatgcaacagattattgacttgcagcccgatttaattgtgacggccgcctttggacagtttttaccaacaaaattgttaaaagctgccaaaattggtgccgttaatgttcatggctcgttactgcctaagtatcgtggtggcgcgcctgtccaatattcaattatcaacggtgagactgaaactggcattactatcatttacatggttaaaaagatggatgcgggcgacatgctggcgcagcgggcgattccaattgaaaaaaacgatgacaccgggacgatgtttgataagttgagcatagttggtcgcgacttgttactggaaacattgcccaagttgattgctggcgaaattacggcggtgccacaggatgaatcccaagtgacctttgcaccgaacattcagccagaacaagaggtcttagacttctttacaaaaacggccgttgaaattgataatcaagttcggggtatgcgaccagcaccaatcgcctatgcggtcttggatggaaagcgcacgaagttctgggatgtgaccccgttagctgacgaagtggtcacgcaagctcctggacaagtggttcgcaagacgaaacatgagcttgtgattgcagccgctgaccataccgcgcttgcaatcaatcagttacagccagctggtaaaccgaagatgacgattacagactatttaaatggggcagcggataaattcgctaccggagagcaggttattagtaaatgagcacagttgacaacacaccccgctggttagcggtcgcggccttagcgaagatcaaaaacggcgcgtattcgaatttgcaattaaaccaattaattaatgatcatcaaatggatcggcgggatatcaatctactgaccaatatggtttacggtgtcattcaacaccggttgaccctcgaatactggttgaccccgtttgttcgacatccgcaccagattgacccgtgggtacgggaactcttattgagcgcattgtatcaatggcagtatctggataagattccacaacgggccgttttcaacgaaacgattgaaatcgctaaggtcaagggccaccctggtattcggcggtttgtgactggcgtcctacatcaaatggatcgttcaggactaccgagttttgatgcgattaaagatcctgatgaacggttgagtgtgacttatagcatgccaatatggttgattcaagaattgcggcgtcaattgggtgctgagaagatggagaaaatcttatcatcattgaaccaaccggctaagcaggcgttgcgcgtcaacccggccttgtcgacggttgaagatgtcacaacggcgctgattaatgatggcttgacaattacgccgagcgagatttctccgttaggactgattgcaacggatggtcaggcgattaatactgaagcgatgcggtatggcatgttcacagttcaagatgaaagtgcacaattagttgtgccggcactcgatccgcagccgagtgatcgggtcttggatgcttgtgcggcccccggggggaagacgactcagattgcggccagtttagatgctgagcagggtggttcagtcgttgcccttgatattcatgccaataaagtgaagctgattggtcaaaatgcggcgcggatgcacgttgctgatcgtgttgaagcaaccgaactcgacgcccgtaaagttgagacgcaattcaatgctgaaagctttgatcggatcttagtcgatgccccatgttcgggactgggattgatgcggcgtaagcccgagattcgttatgaaaaacagttgcaagatagtttgaacttgcaacgaatccaactggcaattttgacagcggtcgcgccaaccttgaaaaaaagtggtatcatgacgtatagtacgtgcacgattttgcaacaggaaaatcaggacgtgattaccaaatttttagcggatcacccggattttgagctgcaaacaacgccaactgaacgagacttgaaaactgatcgaacggaaaagactttgtcgatttatcccgatgattatttatccgacggttttttcattgcttgtttgcgaaaaaaataatggtggagtggtaaacaatggattttgcataccggtcggatattggccaacaacgtgaagaaaatgaagactatgtcggcttttttcaaaataaggctggcatcaattttgcaattgttgcggacggcatcggtggtcaccaagggggcgatgttgcttccgagatggcagtctcgcacatgggctttcggtttgaaaatacaacgttcaaagaacccaatgatgcggtcaagtggctggcaagtgaggttcaagatgaaaatcagcatattattgaaaaggcccgtgaattttcagatttaaacggtatgggtacgacgatggttgccgccttactttttgaccaaaagtttttgatggccaacattggtgacagtcggggctacctttttcgcgacgggcaactccaccaactgacggaggatcattctttagttaatgagttggtcaagcgcggggaaatttcagccgaacaggcccgacaacatccgcagaaaaatattattacgcggacactaggcatctcaccagatgcggatatcgatacgaacctttaccagatgcaacccggcgaccaattgttgttatgctcagacgggctgacaaatatggtgactgatcagcaactcgcgacggttttggcgacgtcccagacttcgacccagaagtgtgagaccttgatcaagttagccaatgcagctggtggcaaggataacattacggcgctattgatggcgcttgatggtgaggtggccagtaaatgacacccaactatacccttagcggacgatatcggatcgtccggtccttaggtgaaggtgggatggccaacgtttacttggctcatgacttaatattagaccgtgatgttgcggtcaaactgctccggttagacttacgtgatgatcctaagaccatcaagcgattccaacgtgaggcactggcaacgacggaacttgttcacccccatattgtcagtttgtacgatattggcgaagaaaatggcatgcaatacttggtcatggaatacgtcaaagggatggatcttaaaaattatattaaagagaattttccgttaccgttacagcaagtgatcgacatcatggagcagatattaagtgccgtggcaacggcccacgcgcataatattattcatcgggatttaaaaccacaaaatattttaattgatgagcagggcaatgctaaaatcactgatttcgggattgcagtcgcgttatctgaacataccatgacgcagactaacacgattttaggttcggtccattatttgtcaccggaacaggcccgcggtagcatggcgacaaaacaatcggatatctattcgttagggattattttatatgagatgttaacaggctcagtccctttcaagggtgagacggcagtttccattgcgttaaagcattttcaaaatgcaatgccatccgtgcgagagtttgatgcagatattccgcaggcacttgaaaacgtcgtcttgcaggcgacaaccaaagacccccgggaacgttatgctacggtcgaggacatggccgctgacttattaacggtgcttgctagtagccgtgcgggcgaaaagcgctttgtaccgcaagatgtcggtaatgatgagactaagatcatgcccagtgcggatattcaagccgcaatcgcggccaatcaagacggtaaaacccaggtcgtagcccataaaagtgagcaagtggcgcctaagcgtccggctgaaacgactgaaagtcagacagacactgatgaagcgccactaccaacacgttcctggtccaaacgccatccgttgcgatggcggctcctattttggggtgggatcatcttgctattagtcgtggcggtgatcgtcggtctagagttgagtcgaccacagatgacgacggtgccgaaagtaacgggcttaagtcagagcgctgcgactaaagtcctcaaaaaacaccatttgacggtcggtactgtccaacacgcaaaaagcaatcaggtagccaaaaatcaggtgatcaaatcaacgcccagtgttaagacgcgggtccaagaacgtgctcgcattaatttggttatcagcaacggtgccaaggtcatgagctttggcaattatgtcaatgataattaccatgatgttcgacagacgctcaaatcggcgggcttcaaagttaaggaaacttacagtacgtcgtcggttgcagcggggcaaatcatcagtcaggacgttgtcgctggtagtcgcgtgatgccgacggatacgacggtgacgtttacggtcagcgctggtagccgctacgtcgagctaaaagatttaactggtgagagcaagagcgatattttggactatgctgaagcgaatgatcttaatgttaactttaagcagggctactcttcagaacagaaggcgggttattcctatgatcaagatccagatggcggtggcaatgtccggactgggtcgactattacggtgaccatgtcacggggcagtgataataacgtaacgacaccacagaatttttatgttaaactaacggtgccgtacaaagcgttatcggccacgactgcccaagccaacgatgttaagatttatttgtatgatgatacccatatgattgagaccgtttatcgcgatattgcaatcatgcggtcgactaagattagtttgccgtttcagctgaccggtaatacgaaggggcattaccgaatcgtgcgtaacggggttacgatcatggaaaagaagaatattaccagcaaaaatgtaacaaaataaagataagtcatgcgcaatgcatgacttttttggtacaatagagaaaagtggaccgtaccaaataataaaaaaggtggtgctaatttgaaaattggacaaattcggcaatcgctaagcggcttttacgacgtttatgcggatggccaaatgtatcggacccgtgcgcgtgggaatttccggaaacggcggatcacgccactcgtcggtgacaatgtggagtttgatgcggcgaccccacaagagggctacgtgttaaagattcttgatcgacagacccagttggtacggccgccagtggccaatgtcgatctaggtatcgtggtaaccgccacaacggaacaagaattttcaacgaatttattggaccgacaactggtggctttggcggtagcggggatcgaaccgctactatactttgcgaagactgatttactaaccgatgaggtgtaccaacaacgattaacgttagcggacgcttatcgccaaattggctatcaggtcatctgcgaacgaacggcattttcaccagccgccttagctgcagttaaaacggcgctggcaggtcacgtggcagttgtcatgggtcaaactggtgcgggtaagtcaacactgctaaatcacctgcaaccagggctggcgttagcgactggtgagatctcacaggcgctgaatcgtgggaagcatacgacccgtaaagttagtttgattccaattgcggatgggttggttgctgatacgccgggtttctcatcctacgaagttttcgatattgccgctaacgagttgacccattatttcccagaatttgtgcggctcagcgctgattgcaaataccggggctgcgtgcatatcaatgagccacagtgtgcggtcaaacaggcactggcagccggggagctgttagcgagtcgctatgataattatctacaattctatgaaaccattaaaaataaaaaagtaatctataataagaaaaagtgagtgagactaatgattaaagttgccccttcaattttaagcgcagattttgcaaaccttcaacgtgacgttcagatggctgaaaatgccggtgccgacgcgttgcatatcgacgttatggatggtcagttcgtccctaacttgtcattcggaatgagtaccgtggcggatttacggccagtaacgtcattgatgttagattgtcatttaatgattatggatcccgaacgctttgtcggccagtttgcaaaggccggtgcggatctgatcggtgtgcatgttgaaagtacccggcacatttatcacgccttacaattgatcaaggatgcaggcgtgaaagctgaagtggtcgtgaaccccggaacgcccctcagcatgattagtgaattactgccactagtggatcaagttttgattatgactgtcaatccgggctttggtggccaacattttctggaccaaatggttgccaaaatcgcggcgttgaacgaattgaagcaacaacacggttatcaatttgatattgaagttgacggtggtatcaacgaccagaccgtcaaggcgtgttatgatgctggtgcgacggtcgctgttgcgggctcgtatgtctatgacagcgcggacccagcgcaacgtattcaagatttgaaggtggcgaccaattaatggcaaccatcgtaaacttactggttggcggaccgaccgctaattatccagcagatttaacgacgattccaggaccatgggtcggcgctgaccgtggcgcgttgcgtttagtgaagcgtggtatccagcccgtgatggtcgtgggggattttgattcaatcgatgcggctgaactccagactgtcaaagaggcgttggtgggcgctgtcgttgtcaaacccgaccaagaccatacggatacgcaattggcaatcaaatctatttttgagcagttgcaaccggacgaagtgcatctatacggagccacgggtggtcggctagaccatttactggccaatatgtggttagtgcttgatccggtatttcgtcagtgggccccacagatcaaactgatcgataagcaaaattcggttcagttctttctaccaggggactaccagatcacgaaggaagcggataaacgctatttggcgtttgtaccgctgatgccgatgcatctcacgttacccgatgaaaagtatcagttggacgctgcttataatgcgtacccgatttcatgggccagtaacgaattcagtggcaacactggtcactttagctttgatgcgggggttctagccgttatccaaagtcgtgatgacagcatggcggatgcgtaggggctatcaaaactccgactaaaataagaccggtcgatgagtcataaactcatcaaccggtcttttaatgtgcagtaatgctgttctgtttgttggtgaaacgtgcaggtgtttagtcgttgctcgttagtgcgcttaaccagaaagttgatgttgaatcagacctttctcgccagatcctagctggtcgttgttgacgaccaggggatggcgagcttgctcagcgattcaggtaatcatcatgggctggtcagggctgaattataaactttataaaaagttgatagaaaattagtgattttaggcaacaaaaaacgccagccacaaaaaaatgtgctggcgatttgctgcgctaaacgcgcgtaactttacctgatttcaaagtccgagctgaaacccaaaccttctttggtttaccatcaactaaaatgcgaactttttgcaagttagctttccagctgcggcggctgtggtttaaagcgtgagaacgcgtgttaccaaagtgcgtccgtttgcctgtaacgtagtcttttgccatgttgatctgcctccttcggtaattcattgataaaaggtcgtctttatcattcactagaataatttatcatagattaataaaggttgcaatacatttctatcaagtaattttactttactgctaaattcccagtttccgggcttctgttaagcagtcgcttaatttttctttcaagagtggttgtgctatgataaactatcgtaaatgaacgcgttaaaacaaggaggctattttcatggctgtcaaaatcaaaacgcaatttggaaccattgatattgataatgatgttatcgcgacggtcgtcggtggcgccgcaacggataactacggggttgtcggtatggcgagtcggaaccagattcgtgataatgttaatgaaattttacgccgcgaaaactatgcgcgcggtgtggttgttcgccaagaggataatggggtggctattgatgtcaacattatcgtcagttatgggaccaaaatttcagaagtctcacgcaatgtccaagccaaggtcaaatataacttacaaaacatgcttggcgttacggccaattcggtcaacgtcattgtccaaggtgtccgggtaatgaacgactaaattgatgttggtggaagccaaggaggaattttgaaattgaaaatcaccacgattactaatcttgaatttggcaaaatggtgcaggctgcttcacaaaagctgaaccaacgcgctgaatttattaattctttgaacgtctttccggtaccagatggtgataccgggactaatatgagcttatcgatggccagcggtgccaaatacgaacgtgaagaaaccagtacaaaagtaggcgacctagcgtcagccttagccaagggactcttgatgggggcccgtggtaattctggtgtgattctatcacaaatttttcggggcttttctaaagccgtagcggataaggacagcttaactgctaatgatttagctgccgccctcgctgccggtgctcagaccgcctataaggccgttatgaagccgaccgaaggaactatcctcacggtcattcgcaaagctgctggtgccggtaaggaagccgttaaaacgactgatgatatctgtgaagttatggatgccgtcgttacggctgctgaagccgcgttgaagtccacaccggacttgttacccgttttaaaacaagttggggttgttgattccggtggtcagggactgacttttgtgctggaagcctttagtgactcgttaagcggcaaggtcgacgaatcgcaggactatgttccggacgatgctgaaatggattcgatgatcgatgctgcgcaccatcaaagtgttcagggtcagttagacccgaatgatatcaagtatggctactgtactgaaattatggtgcgaatcggtgatggtaagttagttgatcacaagttcgattacgacactttctatgattacttagcaaaattaggcgattcattacttgtcatcaacgatgatgaaatcgtcaaggtgcacgttcatacggaacatccgggcgatgtcatgacgtggggccaacgttttggggcgctgatcaaagttaaagttgacaatatgcgtctacaacaagaaaccatcatggaacatgataaggaaggcgaagcgcaagctgctgctcagtccgccttaccttcacaaccacaagttgacatgcatggttatgccatcatctccgtttcgtcgggtgatgggatcggcaagctatttaagggcttgggtgtcaccgatatcattgctggtggtcaaacgatgaatccaagtaccgcggatatcgttaaagctgtcaatgacagtggtgccaagcaagcattagtattgccaaataataaaaacatcttcttggcagccgaacaagctgcggaagtggccgatgtaccagttaaaattatccacagtcagacgatttcgcaagggatgaccgcgatgttggcattcaatgcggaagctgatctggacgataatcaggccgcaatggaagaaaccttgagcacggtcgttagtggtcaagtcacgcatgctgttcgcgacacgacaatcgatggccttgagatcaagaaagacgactacatgggcttggtcgatggcaaaatcgtgattacgaatccagatcgcgataccgctgctttagatatggttaaagccatgcttgacgaagatagcgaactcgtaacgattatttacggcaaggatgcaactaaaactgacgctgatcatttagcagcgaaggtgcaagagttggatgatgaattagaaattgaaattcatgagggtgatcaaccagtttacccattccttgtgtcagttgaataggactaaccgttaaaaatagggcttagcagtgatgctggggcctgtttttgtacgggcggatacttcccgcgggattgaaacgtttttttggtataattagtaccagtaaagtcaattattttagaaagggcggtggtcaggcatgggacaacagttgagtgacgcggttgcaaccttaagtggtgtcggcccagcccgccaaaaaggcttagcggagcttgggattaatacgattgcagatctattgacttattatccctttcgctatgaagatctacaggtcaaagacgttaatgaaatcgcggatcaagaaaaggtgacgctaaaggggaccgtggcttctgaaccggtactagcacgctttggccgtaagaagaatcgcttgaattttcgcttattgatcgaccatgacgtctatatggtgactttttttaaccaaccatacttgatgaaacagattgagactggccaagatttagccgtttatggcaagtgggacgccacgcgcagtagcttgacgggcatgaagatcatcaatcccaataacgcggattcagcgtttggctcgatttatccggccagcaagacggtcaagcaggggacgattcagaagatggtcaaacaggcatatgagttatatgccccagtcattacggacattgtcccagctaacttacgtgcgaaataccgactgttaccgcggcgccaaatgattcatgatatgcacttcccagctagtcaagccgattcaacggccgcacgacgctcagcgacctacgaggaattcttgttgtttcaaatgcagatgcaagcgttgaagcaaacggacgcgacaaccaatggtattgcgattgcttatgataatgaccgactaaaggcgtttatcaaaacactgccatttgaattgacccacgcccaaaaacgagtcgtcaatgaaatttgtttggacttgaagtcaccgaaacatatgaatcggttgctgcaaggtgacgtggggtccgggaaaacgattgtggctgccattgtcatgtatgcggcgattaccgctggttatcaggccgcgttgatggcgccaaccgaaatcctggctgaacaacacgcaaacaacttggctcaggtctttgccgacacggatgtcaacgtcgcgctgttaacgggtgcgaccaagccagctgcccgtaagacgttgctagcagcgctggctgctggtgagatcaacttattgattggcacgcacgccctgatccaggacggggtgacttatgctaatttgggattagttattaccgatgagcaacatcgcttcggggtcaaccaacgggctgcttttcgtcaaaagggcgggcagcccgatgcactagccatgacggcaacaccgattccaagaacgttggcgattaccgcgtatggcgaaatggacgtttctgaaattgacgaattaccggctggtcggcaaccgattcaaaccacttgggtacggagcaaccaagctaattcggcgttaagctttgttcatcaacagattgacaatggttcacaagcctacgtggtgacgccattgattgaggaatccgagacgctggatgtcaaaaacgctgaggccctgtcagctaacttacaagagtattttggggcgagtgttaaagttggactgttacacggtcgaatgaaacctgaggaaaaagacgcggtcatggcggcttttaaggcgggcgacattcaattacttgtttccacgaccgtgattgaagtgggagttgacgtcaagaatgcgacaatcatgatgatttatgacgctgaccgttttggcttggcgcaactacatcaattacgcggacgcgtcggtcgtgggacgaaggcttcatactgtattctagtggctgatcccaagaatcaacaagggattgagcggatgcagatcatgacgcagacaaccaatggttttgttttggcacaaaaagacttagaattacgaggagccggtgatgtgctgggagtcaagcaatcgggaatgccggaatttaaagtgggtgatccgattgcggatttgaccgtgctacaagtcgcccagcaagatgcccacgcaatcgtgcagcaaccggattggcaaagtcaaccggataatcgggcgctagctgcctatctgagtcaaaagttggctgcagtgggaacgctcgattaataacctaaagacagtacttgtgatgagaggaatggtgacacaatgattaaaattgcgattgatgccatgggtggcgattacgcccctaacgctgtgatcgagggggtcgaacaggctcgtgatttatttgaggatacggtctttttattatatggccaacgtgacgtgatcaacgcgcaactgaagaaccgtgatcggattcaaatcatcaatgctgatgaagtcattacgatggaggacgaacccgtacgtgccgttcgccgtaagaagcattcatcaatcgtaatggcggctcaggccgtaaaggatggccaggcggacgccttcttttctgccggtaattcgggggccgttctggcggccgggttatttatcgtgggccgaatcaagggcatcgatcgaccgggattagtgacggtattgccagtggtacgcaatgccaaccaatcgaactttgtgatgatggatattggtgctaatgcggatagtaagccactgaacttgcaacaatacggtgtgttggggacgtactatgcggaacggatgatgcaagccaaacatccccgggtcgccttgctcaacaacgggaccgaagatgacaagggaaataaggtccataaggcagcgtttgaactcttgtcacagactgatggtatcaattttgttggcaatgttgaatcccgagatttgttaaacggggttgctgatgtcgtcgtaacggatggcttcacaggtaacgccgttttgaagagtattgaagggacggcgcgttccatgctcggtttagtgaaagatgccgtctataacaccggtatcagtggcaagttaggcggcctattgcttaaaaatgggtttaatgacatccggtcgcaaatggattattcccagtacggtggtgcggtcttactcggattgaaagccccggtcgtaaagacgcacggttctagcaaagccccaacgatcgtgaacacgatccgtcaaattcgccagatggtcagcacggatatcgtcccaggagttgcggaatattttgccaatcaacaagctaatcagcaagcaagtgtagacattcctgctgaaaacgattagaatactttagtgaattcaagttagtgagggatctttacatgacgaaagaagaaattttcgataaaattgcggatatcattgctgatcggtttgaagttgataaagcaacgattaccaacgaaatgaacttgcaaactgatttggatgctgattccatcgattttgttgagtttgtactggaattagaagacacctttggtagcgaaatctcagacgaagatgccgaaaagttgtcaacggtcggcgaagtcgtcgattacgttgcagcgcaccaagcaaaataagttaattgaccaagcaaaaacaggtagccaacatggttacctgtttttgcttgtctgactacgaaagtaccgatatcattgttattgaccactaaatcatagtataatgttatgatatgcaatgtgtgacctgttgactgactgattatcagatgaatccttacttaagcggacttttaacttgtgtttctatttgttagcttctgatcatccacggtcgattgccacggctgggtgaaactgaacattgcgtgtaagagtagcactgaatacatgtcggaagcactcgaacggcagatgaatgaccaccttaaataatgattcatgctaagttaggcaccaccagtaacagattgtgataactggctgatccaatggggttagtcgatagaatgataacgaaaggaagtttcaaatgattacagaattagctgcaatgttgaaggaacggtttggcattgtgtttaacgatcccgatttattggcggaggcatttacacaagcctcgtatgtcaatgagcatcaggaccaacagttgaagtattacgaacgggtcgaatttttgggggatgccgtcttggagttagtggtgtccgaatatttatacaaacgttataaagacatgccccaaggtaagttgactcgtttacgggccgccatggtttgtgaagaaagttttgcaagctttgcccgtgaatgtgactttcctcagtacatccggttaggcaaaggcgaacaaaaagcgcatgcttgggaacgagattcacttttatgtgatatttttgaatcatttgtcggggcactgtacctggatcaaggacgggaacctgttttgaagttcgttcatcaagtaatttttcctaagctggatgagggtcgttttgatggcgtttttgattataagacgaccttgcaagaatacttgcaacgggatggcgatgtcgcaatcgactaccaattaattgaacaagatggtccagccaatgagcggtcttatgagattgccgtacttgccgatggtcaaaaaatcggtgagggctgggggcattccaagaaggaagccgaacagagcgctgctcggcaagcttattcacaattacagcaaaagtaaccattaataattacaggaagtttgtgtcgaatgcaacttaaatcattagaaatcagcggatttaaatcatttgctgataaaaccaaaattgattttcaagccggaatgacgggaattgtcggcccaaacggtagtggtaagagtaacattattgaagctattcgctgggtcctcggagaacaggccgtcaaaagtttacgtggcactaagatgaccgacgtcatttttgccggctcggctaatcgaaaaccgttgaatatggctaaagtcacgatcacgtttgataacagtgaccactttttacctttggattacgcagaagtcagtattacgcggaaactctttcgcaacggtgacagcgattatttaattaataatcagagttgccggttgaaagatattacgaatttgatgattgatactggtctgggaaaagactcattttcagtgatttctcaaggtcgtgttgaggcggtctttaatgcgaaaccagaagagcgccgcagtattatcgaagatgtcgctggggtcttaaagtacaaaaaggataagttcacgacggaaaataaattagcagaaacgacggattatttagaccgcgtgaacgatatcattgctgagttgaatcagcaaaaggggccgttggaagaacaggcgagtcttgcccgggattatcaagatcaaaaacaaaaatttgattatttggaccgttcgcggcttgttaagaagttgatgattgctcgtgatcaactgcaaggtgtcaatgaaaagttagctagtgccaaggcgttagtggctaagtatcagcaacaagttgatgctggggcaaccaagctagctaattttaaaacccagcagacagctcaattaaagcaaaaagatgagctggtagcacaaaatcttgagctgattaagaccatcgaaaacacgcaaggacaacaaggggttgacgctgaacggcggcaaaaccaacagtctgagcaggaacggctgacggccagtttgaccgcaactgagcaacagattgcgacgcaaaccgagcatcaatcccaattagaacaaacattatctgagcagcaagcccaagttaaggcagtcaaagcgcaagttgccgagttaacgacggcaacgagtgcggccggccgtcagcagttggccgatgagctggaaaaattacgcaatgcttatattgatgaaaaacaagttcaggctgaattgaataacgaagcgaagaacctcgttaagcaacatcaacagtctgggagtcagagcacagcgttagcagaacggctagcacaggctcaggctaacttgaaacgggtgcagacgaccgtggacgtgcacaatcgtgagcaacgtgatttagaaaatcaagttagtcagcggcaggccacgctaacagcccaacaagcccaagtaaaaacgaatgcagagcggatcgacgagcaacagcaacgttggttagacgcggctggcttgatgcagcgtgaaaagtcacggctagaggcgttgcaagctgttcaggaacgctatacgaacttttatgcgggcgttcgaatggtcttacaacatcgccaacagtttagtggcgttgccggggccgtttcagaactcctgaccgttcctgatcagtatactaaggcggtcgaagttgcactgggcggacagttgcaaaatattgtttgtgacacacaacagacggctaaaactgttgttaatttcttaaaacaaaatcacgccggtcgggcaacctttttgcctatcgagcggatcacggctcgtcaacttcccgttaacactgagcgcgatttatcacaaaaacctggtgtgttgggcgtggctagcgagttggtcgattgcgaatcacgattgacggcaatcaaacgttacttgttaggaacaacggcgattgtggacacgctagaccacgcgatggcaatttcacggagccgacgttttcggtgcaaattggtaaccattgatggtgaaacgattgcggccagtggggccatcaccggtggtgcgactcgccatgatgataatgggctactccaacagcaacaatccgcggaaaaaattgcagctaacgttgcccagatgcagtctgaattagtaacctatgaacaagggctagcagatcttaaaaaagctaaccaagacttaacggttcaagttgaaacgacccgccaacaactaagtgagcttaaggatcgccttagtcagacacaggcccagttacaggcggcacagagcgagcaaacgcagctaagtcgtcaagttaaggctttaacttatgagcagcaacagacgcaggctgatgatagctatgaagacttagtggctcgtaatcagcaagcgcaagcggctaatgcggctaagcttaaagactatcaggaccaaatgaaaacagtccaacaacagcaaacggattacgaaagttatcaacagactcaaacgacgaaattacaagcccagcgtgaacaactgatcacgttgcaggaacacgtgaaacaaacgcaacgacaattagaacaatgtcaggcgaccttggcgcaaaatgaagcgacgaaaaagcaaattcaagcggatttaacagcaattaaaacaacgttagcgagccagcaaatgtcggtcgcagaacgcgatacggtcttgaaaacagctaaggctaaacaggctgtggttgaagaacaacggaaaacgtgtgaacaacagctagcaacgcttaatgatcaggttgaagaattatcgacccagcaagttcggttgcaacaactcgcagcggctgcaacggatgattaccgtcgcttggaattgagccaaacaaaattgactggcgaagtcgaccacgccacggctgatctggctgaaaagtaccagttgacagttgccgcagcacaagctgacgtcagtgacttagcgttacctgcgattacagaacagttgaaactgcttaaacggggcttggatgagattggaacggtaaacctcggcgcaattgacgaattcgagcgggtcaaggaacgctttgactttctcaataaccaagcttccgatttaactgaagccaaggaacacttattgcaaacaatggctgatttggatacgaccgttgccactcgctttaaaacggcatttgatcaagtcgctagcgaatttagtacgatttttgaacagatgtttggcggtggtaaggctgaattgatcttgaccgacccagaacatttattgaccagtggggttgatatcatggcccagccacctggcaaaaaatttcagcgattaagtttactttctggtggggaacgggcgttaacggctattacgttattatttgccattttagcagtgcgccccgtgccattcagtatcttagatgaagccgaagctgcgttagacgatgccaacgtggatcggttcagtcagtatttgaatgattttcaaacgggaacgcagtttgtgatcattactcatcgaaaaggaacaatgatgcacgctgacgtactttatggggtaaccatggaagagtcaggtgtctccaagatggtctcagtctccttggcagatttaaaagatgaacaaaaataattaaaggaagtgttgaagatgggactatttagtcggttaaaaaaagcgtttagtttaccagaatcatatgacgctcaaacaacgtcagctgccagtgaagcgccagcaacgacgagtcaagctaacgcaccggtcagtgacgaccgggccccttcgtcacaacagccagctcgctcggagggcgcaacaactgaatctattgcgacaccggtgtccaatacagccgtaagcgaagcgacaagcactgcggacgaaccagcgacagtaaaatcggcagctactagtgaagccccggccgatagcacggcggcagtgagtgcacagtctggttcacaagcatcactgcagtcggcgacggtgtcggaagcgccactcacagccagtgcaatggttgcccagtcactagctgcattaagtgcgagtgcggcacaagttagtcaagcggccgcgagcgacgtggcgttagcgactaagtctgatgcggtagttgaaggaaacgctatgtcagaatcagtagccagtacggcgccagcagtcaagtcatcagcgacgactgcgactgaatccgccgcaccgactgttaatgcggcggctgattcggaatcggctgagccggagccaactgaggcagaacgttatgatgaaggactgaaaaagtcgcggaaaacgtttggtgatcgtatcaatgccttcttggctaatttccgccatgtcgacgaagcgttcttcgatgatttggaagatacgctgattgaatctgatgtgggttatgagaccgcgatgcgaattagtgacgagctacgtgacgaagttaaattaaagaacgcgaagagcaagaaagaaatctcaagcgtcatcgtcgaaaagctcgttgatatgtacggtgaagctggtgaaggcgaggataactcgattcacatggctaagagtggtccaaccgttattttatttgtcggggtcaatggtgctggtaagaccactacaatcggtaagatggcgaacatgtacaagcagcaaggcaagaaggtcttgttggcggcttgtgatacgtttagagccggtgcaatccagcagttgcaagtctgggggcaacgagacggggttgacgtggtcgctaaggccgaaaaaagtgatccagcggccgtttgctttgacgcggttaagaaggctaaggccgaagattatgacgtgctctttgtggacactgctggtcggcttcaaaacaaagtcaacttgatgaatgaattggaaaagatcaagcgggtcatcacccgtgaaatccctgatgcaccacacgaggtcttactggtgctggatgccacgactgggcaaaacgcgctgaaccaagccaaattgtttaaacagtcgacggatgtcagtgggattgtgttaactaaacttgatggtacggcacgtggtgggatcgtcttagctattcgtaatgaattgcatcttgctgtgaagtacgttggtttaggtgaaaaggtgactgatttacgaccattcaatgccaatgactttgtctacgggttatttaaagatattatcacgggttaaatcagttgatgatggtcttaaattgaaagccagttaatgaaatggtaattgttctcagcacgaggacgattaccatttatttttaccccaaatggcgactgatagttgacgaatggcgataaaatcggtactcttatttagtgtgtagtctgtatgataagcgtgaggagtccccacatggaaattgaaaaaaattatcgaatcaattcgttattcgagttttatgaaccgttattaacgaataagcaaaaagcctatattcaactgtactacgctgatgactattccttaggcgagattgcagcggagttctcagtttcgcgccaggccgtctatgataacatcaagcggaccgaaaagattttagaaggttatgaggctaagctgcatctctaccacgactttgtggaacgtaatcacgaagttgacgcgatctctgactatattaagcaaaattaccatggggatacccagttaattaagatgattcaacaactagtcaacttggaagctgactcagaataataataaaggttaggtgacactaatggcatttgaaggcctaacggaacgtttacaaaaagcaatgaccaatttacggcgcaaggggaagatttcggaaagtgatcttcgcgcaaccatgcgtgaaattcggttagcattacttgaagccgatgttaactttacggtggtcaaggattttgttaaaacggttcgcgaacgtgcgctcggcgcaaaggtgctggaaggcttaaatccagcccaacaaatcgttaaaatcgttgatgaagaattaacgaaaacaatgggtgaaaaggcagttccactgaacaaatcgccgaagattccaacggtcatcatgatggctgggctccaaggggccgggaaaacgacgacggtcgggaaattagccctgaaattaaagaacgaacaggatgcccgaccattaatgattgcggccgacgtttaccgaccagccgcgattgaacaattgcaacaagttggtcgccagatcgacgtgccggtcttccaattaggaaccgatgttgatcccgttgaaatcgtgcgtcaagggatggcacaggcgaaagaaaaccacaatgattacgtgtttattgatacggctggtcggttacaaatcgatgagcagttgatgaacgagttggccaatattaaagatctcgttcatcctgacgaaattttgttagtgattgatgcgatgactggtcaaaacgccgttaatacggcggagggctttaacgataagctggatgtgaccggggtcgtcttgacgaagttagatggcgatactcgtggtggggctgcactatcaattcgggccgtcactggtaagccaatcaagtttgtcggtcaaggcgaaaagatgactgatcttgatgtcttccatccagaccggatggcggatcggattcttggcatgggtgatatgctgacgctgattgaaaaggcgcaacagcaatatgacgaaaaacaagccgaagaaatgaacctgaagattcaggaaaatacttttgacttcaatgactttatcgaccaattagaccaagttgacaagatggggaacatggaagatatcatgaagatgattcccggcatggctaacaatccagcgatgaaaaatatcaacatggacccgaaagacattgcccatatccgggccatcgtttattcgatgaccaatgccgaaaaagcagatccggatttgttgaacccatctcggcgtcgacggattgcggctggttccgggcggccaattcatgaagtcaaccggatgatcaagcaattcaaccagaccaaaaagatgatgaatcaaatgtccaaagggaactttgctggtatggaaggtctcatgggtggtgccaatggcggtatcggtggtaagatgcaacaaatggccatgaagcgaatggttcgtcaaactaagaagaaaaaacaaaagcgcttagccaaagcaatgcggcgtcgcaaacgctaatttataagtttttttagcctgtcaagaaaaagtcctttacaagctattgatttactggtatattattacctgttaaagaattcgggaggtgtttaaatgtcagtcaagattcgtctaaagcggatgggttctaagaaaaatccattttaccggattgttgtcgcagattcacgttcaccacgtgatggtcgttttatcgcccaagtcggcacatacaacccacttacagaaccagcccaagttaaacttgaagaggaagatatcctcggttggttgaacaatggtgcccaaccttcagatacggttaagaatatcttatctaaggccggtatcatgaagaagtaccacgaagctaagttcactaaataataaagcggtaatagatcatggcagatattaaagctttaatcaccacggttgtcaccccgttagttcaatatccagacgatattaaagttgattttaaggaaaccacgcgttatcttgaatacaacttaacggttaatcccgaagatatcggccgggtcattggtcggcagggacgggttgcttcggcaattcggacaattgtgtatagtgtccgagtttcaggacctaaacgtgtccggcttacgatcgaagacggacaacaaaaaaactcttgagcgaagcagtgatgttttgtttaagagtttttttatatcttgttccagtttttgaggacgagtcaaagtatctcgatgaccgtcgttgagtagattagttgtaacatgttgatgacatttaaaacgaataacaatcaagctaattaagaggaggaagctaatggattactatcgtgttggcaccctagttaacacccacggtattcgtggtgaagtgaaagtcgttgtcgtgactgattttccagaagaacgctttaaagtagggcaacaattgagtttatttaaaaccccagatgaaacgactggcgggattactgtcaaaatcgcgaaggcccgtgagcaaaagggactgtactttcttacctttgaagggctcgataacatcaatgatgtggagcgctataaggggtggacgatcaaagttcctgctgaagcattacatgccttaccagcgggtgagtactactatcaccagattgtcggcctacaagttgtgacgaccgctgacgagcctttagggactattaaagagattctgtcacctggtgcgaatgatgtttgggtggtcaaacgggatcatggtcagtctgacgtcttactacctaagattccccaggtcattaaagatgttgacttggatgcgggcgtggtgactgttgaactaatggaagggctgattgattaatgcaaatcgatattttaagcctgtttccagagatgtttgcggggccgcttcatgagtcgatgattggcaatgccattgaaaatgatgtcatcaatgttgatgtcactaattttcgggattttacgaccgacaagcataatcatgtggatgattatccgtatggtggtggtgcgggcatgttactccaaccacaaccgatttttgatgctttggccagcgttcaggaaaaacacccggcacccggtcgcgtgatcttattggatccggcgggagtccagtttaatcaacacgttgctgaagactttgctcaggaagaacacttgacctttatttgcggccactatgagggttatgatgagcggattcggtcattagtcaccgatgaagtctcgctcggtgattacgttttaactggtggtgaactgggtgcaatggtcatgattgatgcgacggtgcggctcttaccaggtgtgcttggtaattcggaatcggctccgggggattctttttcgagcggtctcctggaatacccacaatatacgcgtcctgctgattttcgtggtatgaaggtaccagatatcttactgagtggtgatcatggaaaaattgatgattggcgcttagaacaggcgctgaaacggacctatgaacggcgcccggatatgttgacggggctatcattgtcaggaaaagctaaacagatgttagcagatatcaaggcggatgagtcggaagtgtaggctatgccgttaattaggacaagttagtcgtgaagagttcaaaaaaacttgcgtgcccaccctcgaatatggtattctatttattggctattgtgcccattaacgatgttccgctgaccaggttgtcacgaatgtcggcgaaaggaagaaatacattatgcgtcaaaaccaattgatcgaaaagatcaccaatgaacaacttcgtacggacatccctgatttccgtgctggagacacagttcgtgttcatgcacgagttgttgaaggtactcgcgaacggatccaattatttgaaggtgttgttatcaagcgccatggttccggtatcagcgaaacttatactgttcgtaagatcagtaacggtgttggtgtggaacggacattcccattacacacaccacgcgttgccgcaattgatgtcgttcgtcaaggtcgtgtacgtcgtgccaagttatactacttacgtaacttacatggtaaggctgctcggatcccagaacgtcgtcgtggctaaatcacaacgtcaacagtcatcggttgcagcttaggctgaactgatgatggaaagctagttaatcatttttaatgattagctagctttttttattggcgaagttagtgacacgctcaatcgtcaaatcatcgaccaatttaggtcggttcacaatgtgagcatgctgtgcttgggtttatctcttaacaatcttacgagatagctcgtaattcctaatttgaagtattatgatagtaatacgagtacgcgatgcttcttggaatacgtcaattagctgaatatgaatcactcgatatcagactaaactgatttatctgaactggtttgtcgcgtatttgaccagtataactagtgctaagctggcggccgggttaattaaacggggaattgctcagagctagcacgataagataaaagagagttaggtgaacgccgatgtttggacatacggggaaacatcaggtcgatgaacaggcgttattgagtcaattagttgacttcgttctcgacacgagtcttaccgaccgtgaacgtaaaatcgggttgatggccaaagccgatttggagcatcatcgctattcaattgctgtgttaaataaattagtggtcagttttcaaatggaggcgctacgcaacaagggcctctcgaaggctgcttcaaacttttatgatcagatttatccaatattagtcgcggccaaaccaatgggaacgaatttaggctatattgggatgcatagtacctatttagattagggtgtgtcagtaacagcttaaatgagaatatccgtgcggcatgtccgtgcccctttgaatgaaacccattcagaggggctttttggtgtgaaaatacagttcatgatttgcgcgtcttaacaatattaggtgatatggtcggcgtgcaggcaatgaaaattagttggtgccgtaaaatagctggcaaaccatttcagcagtagaacaaatgatatacattgtttgataaccacctaactgggatacgggtgcaatagattcaaagtaagtgtgtcagtatgtcggttatatcagtatttttatgcagcgttatagcatgaactgatactgcaattaaataatctaaaaaataattttgtctattttttgttatgcacttgttattttaacttatttgaacgtatactaatgattgaaggggtcaatcaggtgatagcttgatgattaacgcgattgtttcagtacgttatgaagcgcaccaaatattactcagctaaataacttgattgtcccaggtacggttgaactttggaggcagaattatgcggaatcgtttaaataggttgggattggaaagtaagtctcattataagctttataaatcggggcggcgctgggtggctgctagtatcacggtattttcagttggcatcggtttgacttttagccaagttgaacaagtgaaagccgcaacgggtacgggggttgacacggccgacaatagcgcaagcgttagttccgacatggcagaaccgagcaatgccgttgtactaaaatcatctagtacggcgacagccacaaaggccgtgactcaggatactaaagctactactgattcaactggggcaacttcagcttccagtaatcgtcagtcggcagcagctacgaagccggctgccgaagtcggtgctgcttcaagcagcgctgactcaagtgctagcatatcaagtactgatggctcaagtgctagtgcaccaagtgtcaccagtaaatctactgacacggaagccacatcaacatccgcaactaaaacggctactacgagtgttaacacggatacggcaagcactaagatgaccaattcttcagtagcaagtgatgtcactgcttctacaccagctagccaaacgcgtacggaaactgagaaaacggccggcacccatactgctgaagcaccgaccattacgactgcagtgacaagtcgggcactcccattgacgggtgcgctagcgagcaggtcagcaaacacgccggtcactaagtccgcagtaccggcggtttcagctatcgccagtgaagctgaaacgaagccgaccgtatcgttagtaactacggggaccgtgtcgatgaattatggcgaggcgtcgctggcggatctagaatcttatattagttctccagatgagacgccggctaacgacatcgcctactatattcaagatgcagcgggcaattacttagaagatgtaaacggcaacaaggtcaatttattatatgcactttttctggactctgctgatgtcaatgattacgttgatgttgtgtatacggatgaacatgggcaagtcacgaaatattccggagatacggaccttgcaacgcttacccaaattggcagttacgcagtgacgatcaatgcagcgggtaaagctgggatgagccgggttatgcaaggttataatgcttatgataccaccagtgatttggatgactttgtcccaaccttttcgactggggcctccgattatacctttacaattaagattgtccctgtaaaaatcacagccaccactggtaagaatgggctaattatacttcggccttcacagccgtatacgggagcattgacaatgttgccggtaatcaccgttaaaaatgcaacaaagcgaaatatccttcaaattagtaacggtgaaatcggcgatgctaaaccaggtgtagccggcaaggtcggtcaaagtattttaacgccggcagactttacttacgcgtatcaaggcaccgatgctaacttgaccgggacggacactggccaatatacaattactcttaatgaagcaggtcgggcggcagttcaagctgcgttggggtcgaattatattctggatgatgcggcagttttcaccacgattggtacggtgcaggctgctggtctcgggttaacgatagccaatgatacagtgacctataatggcaagcctcaggggacatccgtagctgtaacgactggaaccgcgtatgatcactttgattttactacgacgactgccacgaacgtcggtacctatgacgacctgacatacgcgttagcggatcccacgcaagcggcgattttggctaagaactataccgttaccacgacggatgggacgttggtgatcacgccagcagatctgacagtcacggtcaaggatgataatgcagtttatgacggccgcgcacatggcacgactgccgctgttactagtgggaccaattatgatcagttagcatttaccgcagttgcggcagatggcagtggtgcgacgacttatactaaggtcggcacttatgcaatgactgggaccacggcagccgataccagtaattataaaatttcttatgtcaatggaacgctgacaattgatccagccaaagcaacaattacgatttccaacaagatttattggtcggatgggacgcaaaagaatttggcggcggtggttactgggacagttaatggtgagaccttaaagtatcgtgtgaccaacggcatgagtgcggttggaactaagacaattacggccactcctgatgctgatgattcggtgaataaaaactataccatttcagtcattcctggcaccttgacaattggtgatattgcggttaagtacctctacgaacatgtagatgctaatggtgagactcaggtagatgcttcggaaactggtacggcgacacatgctacggacgcaacggccacggactatttgacctacacgacggcagccaaacctaagacgggctatgtgttagcacccaatactggactagcctataatggcacgttaactgatcagggcggtaccgtgacgtatcgttatttggccaagactgaaacggcgattgtaacgtattttgaccaaactgataacaaggttattaagacggaacccttacaaggagcgtacgggacaacggatgcgtatcggacggctgatacgattgccgcgtatgagaatgcgggctacgacctggtcgatgatgactatccaacagccggggtggtctatgatcaggacggcagtgttcaagagtaccaggttacgcttgttcataaatttgtaacacgcacgccagataatccgggtacgccaggcgagccgatcgaccccgataatccaaacggacccacatatccagtggggactgactttgaggatttaactgagcaagtcagccaaacgattcattatttatacaaggatggtcgcactgctaagccggacaatgttcaagtggttaattttagtcgtaacgtcacggtggatgaagttaatggcacagtcgtctacacggattggttgactgatgatgggaccatgactggtcgttttgaggccgttgattcaccttcgattactggttatacggctgacccaaccagtgttgtgggtcgtgatacggtgagtgggacggatctcagtccagatgtacaagtttattatcaggctaatcccgaaaaagccacggtgatctatgaagatacgacaacgggagtggtgctggcgacagacccactaactggtgattatcagaccgtttcgaattatcggaccgcagatcgaatcgctcagtaccttaatatgggctataaagtggtcagtgatggctacccgacagccggtgctgtgtttgataaagacggaggtactcaggcttatactgtcaaattgcaacataaactcctgccgcttaccccagataatccgggtacgccaggcgagccgatcgaccctgataatccaaacggacccacatatccagcgggtacggctgtgcaagacttgattaagcaagttgatcaaaccattcactatcagtatcaggataaaagtactgctgccgacgctaatacgcaaacaatcactttcaagcgcagcgtgacggtcgatgaggttaacaataagctaacttataccgattggttgactggtacggcaacgactggtcgttacatgccagtcgattcaccggaaattaaaggctatgttgctgattcaacgcgtattgcgggtaataacgaggtgcacaatgcggatgctgacacgaacatcgtggtcacgtatcaggctaagccagagaacgccacggtcacgtatgtagacgtcactacgggtaaaacgctcgctacggatcatttgactggtaactatcagaccacgtccagttaccggacggctgaaacgattgcgagctatgtcaagaatggctatcaactcgtacgtgataattatcccgtatcggggatgctgttcgacgtcgatgattttgccaaaacttataccgtgacactgaagcataagttagtcacggttacaccagagaatccgggtacgccaggccaaccaattgatccagacaatccagacggaccgaaatatccagctggaacgaccgcccaagatctgacgaaacaagtcagtcaaacgattaagtatcagtatcaaaatggggcttcggctggcactgacagcgctcaactgattacgtttaatcgggatgccacgattgatgaagttgatcctaccgtagtttatactgattggctggatggaacttcagctactggtcgttataccaccgtgacgtcacccgtcattactggctatacggctgataaaacacaggttgctggtcgtgattcagttgctaatacagattcagacacacaggtggtcgtcacctatgcggcaaaacctgaaaaagcaacggtcacttatgtggatgtcacgacgggtaaaacgctcgctacggccaatttgactggtgactatcggacacaatccaattatcggaccgctgaaaccattgcaggttatgttaaaaacggttatgaactggtacgtgataattatcccgtatcggggatgctgttcgacgtcgatgattttgccaaaacttatactgtgacactgaagcataagttagtcacggttacaccagagaatccgggtacgccgggtcaaccaattgatccagacaatccagacggaccgaaatatccagtaggaacgaccgttcaagatctgacgaaacaagttagtcaaacgattaagtatcggtatcaaaatggggcttcggttggcactgataacgttcaactaataacgtttaatcgggatgccacgattgatgaagttgagcctaccgtagtttatactgattggctggatgggacttcagctactggtcgttataccaccgtgacgtcacccgttattattggctatacggctgaccgggcgcgggtcacgggagacaatgcagtaactagtgcggcgcaaccgaccaacattattgtgacgtatgcgcttaacgcagaaaaggcgacggtcacctatgttgatgttaccacggataaagcgctcgcgaccgtcagtttgactggcgattatcagacatcatccgattaccgcacggctaacacaattgctgattacagtaatcagggctacgtgcttgtccgcgacagctatccagtttcaggagctattttcaatgatgatggtgtcgttcacagctatctggttcagcttgcacatgtgacaactgcgacaaccgagaccaagacaatcacgcaaaccgtacattatcagagtacggctggcacgcagttgcacgatgatacggtcagagcgatgacattcactcgtactaaacgggttgatcaggtcaccggggacgtaacgtatagcaattggtcgactaatcaggcggatcacacttttgagcgcgtcgcggcgttcagtattccgggctatcatgcggtggtaacgggtactcaggcagtcatggttacgccagctagcgtggatgatgttcaaacgattcgttacgttaccgataggccttcaaccggtgagacaccaaaaacaccggtgaagacggtgacagttaataagtcggataaaattaagacgactgacacgccagataaagtcgcaacggtcaagacgccggataaggctcagaccgtcgcaacaacaactgctaaacaagctagcgtcaagcggtcagtggatctcaaacaagcacaggctgttgaacagcctgctcagacacgaccagccaatgtaaaaacggttaaactggcgaagacgactaaatccgttaagccaaccgcggctcatcaatcagccacccacaaacaagcgactttaccgcaaaccaatgataatcggcaagctagtgttgcggcggaactacttggtttgaccgcagcaaccttactagttggtgtgagtgcaattttgaagaaacgtcataattagccgttaaatggaggcgttaatatgactactttaatcgatatcacgggtcagaagtttggccgcttaacagtcattagacgttgtggaactgccaaaaatggcaatgccctctggttgtgtcagtgtcgctgtggcaatcagaccaaagctgattcgtacgcgttgcggcatgggcgagcaagaagctgtgggtgtttgacacgagaaagtcggtcgcagttaattcgacgtaatcccaaaacggctgccagtatggggcggttaagcaatctgaaaattcatgatcatcacactgatttaccgtcaaagattatgtctaagcgtaataagagtggtgtcatcggtgtcagctgggatagcaatactcaaaaatgggtggcgacatttttctacaaggggcgctacctgttacacaaaccgtttcagcactttgaggacgctgttcttgcccgccagacgatggaaagccgctatttaaataacaaagtgtagtttacagttcttccttgatagggcctgatccttgtcagagaagagcttttttgcgttacagcaacggtaccagcttcttaattgggttaggggaatcttttcaaaattgtaagtaacaaaaaggattaatactggaatgtcaaatgacaatctgtatctgttttgtagcgacggaaatcttcaaaacaactaacttgtatatgacaactgtaacaacgaggtggtcgttgattgggttgggctaacaagtatcttggaagtggtcggtgaaatcgttagtttcatgatgaaactagtcattggcacagatgagttaattgatgaggatcgagtcgctccgttttcgagttttcaaacgtggtccggtataataaagccaaaatggtgactagggggataatcacatgattgaaattcacgaattaacgaaacgttatggggataagacagcattgaatcagcttactttaaccatcgcatcaggacaaatcttcggtttgctgggccacaatggggcgggtaaatcaacgacgatcaaaaacttagtcagtatcattaaaccgacgagtggcacggttacggtcgatggcttagaccttgaacagcaacgacaagccgtcaaagaaaagatctcttacgtaccggacacacccgatatttttcttcaactttcggcgatggaatattgggacttgatagctgccgcttaccagcaatcagaggaagccgttcagcaacggcgacagcagctggtgtcactgttcgatatgactgaacacgttgacgaacccatggctagttattcacacgggatgcggcaaaaagccattttgattggggcgttgcttcccgatccagatatttggattttagacgagccgctgcaagggttagacccccaagctgcttttgatttgacaaatttgatgaaggttcatgccgccaaaggcaagacggtcattttttccacccacaatctggatacggcgcagcagttatgtgaccgattggcaattttgaagcaggggcaattgatttataccggttcggttgaacaattactagctcaacatccgcaacaatcacttgaggcgatatatttacaaatggccgggcggttgacggatgatcaccttgtcgatgcgctggagggtgagcatgatgcataaaagtcagttgcgtgttttgttggctgttaatctcaggttgttgaatccgcaactaacggatcggctacgtaaaaagggcgcttcggggccagccttgagtaagaagctaatgcggcaattttacttgaatgctttgatgtttcttggcatttatggcttgacgatgttggcctttgattttagcaagttgccaggcatgtttacgttctatgtggcgttatttatcttattgggaatttcacagagtatctcgggtatttataacgtcttctttgccggcaatgatcttgttgaatacttaccgttacctttccgcaatcaagaaatttttatgagtaagattttagtcgtgatattcaacacggtaccctttaccattccgttactcttaatttttatcatgaccgcaacacgggcaggaatctttgtggtgttaggcgtgctgatggccgtcttgatgtatggcctaatactgagtctgttactatgcttgtgcgccctaatagtttttggcttaaccaagctaaccgtgtttcgcacccatcaaaaaatggtgatgaacgtcatgttaggccttaacgctgtcttagtgctagtcgggctctacttcatgaatcgcggctcatcatctgacaccggaacgcaggttgaccgcgcagcattacccctattgataccgatttttaaagttttcacgacgccgttgacaatgacgagtttgctaacctgggcgagtttaattgtcatctcgctgattttgttcgcactgacaggacggtttgttttgacccacttagcggaacagcttacgcaagtcaattcagtgttagtggcaacaccaccgcgtcgacattcacgacaacataaccgcaataaaattttgcgtacctaccagtttcagttactgaaagaacccagtttaaccttacaattattcacaaattcaatcctgctgccattgattttagtcgggaccgttctcttttcggggaccgcccctaattttagtcggctatcgctgaactggctcggtgtctggtttgtcagtgggatggctggtgcgatcatcaatgttaatcaaacctcattagtcggtaacctcatttcacttgataaaatgaactttgactttgtgcgtgcactgccaatcccaatgtcccgttacttacgacaaaagttttacttgggttattggttccagatcatgattaatggcgtgatggttctagtggtgggtatcgctgggcgagcaccattagccctagatttggctctaatattgggcgctgcttgggggacgtacctagctgcccaacattactttaagcgtgattatcagctacggctgacgaattggactaatgtgacccaattgtttaatcggggcggcggtaatcttggtttgatgcttaacttgttggcctgcagtattgtgggtgtgctgacaattgtgatctatagtgtgctgattcagctgttcacggcggcagctatgctgattaatatcattgtattagttggcgtcggaattatttctgctggtttggtctggcattactacaagactttttggcagcaacttgactaataagtgttaatttcacagtcacataatattaaattaaaataaaagtgttgacaaattgctcattgagctttaatgttaatgacaacttaatattcgtccatgaaaccgatgaagtggagatcaagataatgatgcccgtaaagagagtcgccgttgctgagagtgcgatcgaacgcaaattattaaatggaccactgagggcgcgactaacgaacagttttgttctactacctcgcgacgatagggagccgtcaattcccgggaatgtgtttgcatttcgctaagctgggacccaagtctaacctgaatggggtaatttggtgtccaaccaaggtggtaccgcggaaaaatccgtccttgactgtcattagtcatggacggatttttttgatagggggcagttcaatgcagcaacgatggcaattaaccacaactcaagtaaaactatcttattaatgaggagtggttcaatatgaatccaacattaccaaccttgattccttatcaggatcattatccctacgtaccagtgatggtcaaacgaccactcgccacatttgaccccattgcggttgctaaaattgtccaccagatggggaacggtttcgcgctgacgattgatcggcaccaacgatatagctattttagttttaaaccacagcgaagtctcacgggccggcaactagccaagcacaaacgaccagctaatgagacactccaagccattctaaaccaatatcgaacaccacgaattcaaggattaccaccatttacggggggcttgatagggtacttcggctatgagtatgttcaacaatttgtacccaagttgcatttgaaataaccagcaaccgcagatctcgatgacttaggtttattcttagttaggagtgtgctcgtctatgatcatcgacatcatgagcttgggttgacgcagctgatttcaactgcggatttagaggcaacttacgccgtgactcaaacggctctaacgcaacagttagccgccattattgaacaattacagcaaccaatagctctgccaccatttgacttacagcaaccattacacatgcaagcggatcaagcgacctatgcgcgtcaggttgaccgaattcgccaacacatctacgctggtgatattttccaaatgatatatgctaatccatgtttggggaccatgagcgggtcattgctggcagtttatcagcaacttcaaaaaacagcggccccgtatacctgttattttaaacaggctaatttcgaaatgacggtggcctcaccagaaacgttagtaacgaaggatggggaacaagtcgcgacgtatccattggccgggacgagacgccgtggtcgaacacctgccgaggatcagcaggtggctcatgaattacaaaccagccctaaagagattgccgagcacaatatgttagttgatttgggacgtaacgatttaggacaagttgcaaagtttaaaagtgtccgagtgactaatttacggcgattaattcgttattcgcaagtcatgcacttagggtctcgggtggccgcagaagtggcgccgactactacagcactccaagtgcttgccgctacttttccagctgggacgttagctggcgcgcctaagattgaagcaatggccctgattaatcattatgagcaggtgccgcggggtgtttatggtggttgttttggttacttggattgtaacggtaatttggacatggcgattggcatccggctggcctaccggatgaatgaacggttagtgattccagcgggtgcgggcattgttgctgacagtatcggcgctcaagaatttaaggagtgccagaataaacaacgagtgatcgttaatgcagtacaagacgcgaaaggacgagttaaagatggaattattaattgataactatgacagttttacttataacttgtatcaactaattggtcgtctgacgcccgatgtacgggtcattaaaaatgacgatttgacggttgctgcaatcaaggcattacaacctgaccatatcattttatcaccagggccggggacgccagcccacacgggagttagtccacaagtcgtgcaacaattagctggtcaggtccccatattggggatttgtatgggattagaagtgatggtcaccgcttttggcggttcgctgcaaggcgcccagcatttagttcacgggcaaagccacgttaatgcacgtgcagccgtcatcactatttaaagattgtccgatgcagttcatggcagcgcgctaccactcgttggtagctgatgcgggccgtttgcccgttaactttcgaatcattgggacaagcgatgatcaggaaatcatggcagtggaagatgtgggccgtcagctgtacggcgttcaatttcatccagaatcaatcatgacgccagccaccgttggtgagcaactgatccgtaattttttagcacttaaacattaagcagacgagagtggaggaatacttatgattgaaacagcgattgcacaactcactaaccaagaaaatctagactttacaatgagccaacaagtcattacggaaattatgaaaggtcaagccaccgacgcacagattgggagctttttgaccgccttagccatcaaaaaggcaactatcaatgaaattgctggtgcagcaactgcgatgcgttcccaggcgttaccttttaaagttaaacggcccacgctagaaatcgttgggacgggcggtgaccggtcgaattcgtttaatatttcgacgaccactgcgctagtggtcgctgctgcgggtgtaccagtgaccaagcacggcaatcgtgcggcgtcgtccaagagtggtgcggcggatgttttagaagcactcggtatcaaaatcgatctaacgcccgctcagagtctagcattgctagagcggaccaattttgcctttatgtatgcgcgcgaatatcatcaggcgatgcgattcgtcgctccggcccggcaacaaatcaagattccaactatttttaatatactgggtcccttagccaacccagctcatgctgagatgcaactattaggggtataccggcaagctttaatggctccattagccgaagtgttgacgcgtttaggtgttaaacatgccatggtcgtgcatagccgagacggcttagatgaaatttcagcagcagcccctacggatgtgatcgtaattaatcatgggcagcaagtaacgcgaatcctgacgcctgaacagtttggactgacgcgttgtgaccatgcggctcttattggtggtagtgcccaagttaatgccgccatcacgcgggcagtgctcgctggagaaccgggggcccctcgtgacgtggtgttgatgaatgccgccgcggcgttgcatattgccaagccacagttggatctagcggccgcttttgagttggcccagcaaacaatcgatcaaggagcggccgcggctaagttggcccaattaattcagagtagtcaggcggtgatggcctcatgattttagatcaactcgtccaggcgagtcagcaacgggttcagaaggtaccagttagggagcgtgtgaagcgcattcaacaagctcgaaaaatgaccacccccgttttatcatttgaagcaatgctggcccagccgggcttacagcttattggtgaagttaagcgggcgtcaccttctaaggggctgattgcggctgagtttgactatttacagattgcgcaagactatgttgctgctgggatcgatgccatctcagtgttgaccgaaccccggtattttaaaggacagttgtcttacttacaagccattgcgcaaacggtctcggtacccacattacgtaaagattttattgtagctgctagtcagattgcgagtgctcgtattgctggtgctagtgcggttttattgattgttgctattttaacaccggttcaactgcaggctttcattacgttggctcatgagctgaatttaagtgcgctagttgaagtccatacaacggctgagattaagcaagcggtggcggctggggcccggattattggcattaataatcggaatttgaaagatttcagtgtcaattttgcaacgagtcgccagttgcggcaagcggttccggctgagtgttatgtgattgccgagtctggcattcaaacgtcgacgcaagtacaaacgttggcggccgccgactttgacgctattttagtcggcgaaacgttgatgcgtgcgccagataagcagcaagctgtcagacaattgcgggcgggggtgcgtggatgacacaaattaaaatttgcggtttgatgcaaccagcggatgtcgtgatggttaatcaagcgctcccagacgcaattgggatggtatttgcccccggtcgacgacgacggattacgatggcgaccgcgcgccaactgtcacagcaattagatccgcgtatccggcgtgttggcgtgtttacaactaatcaattatcggaaattttagctctcgtgcaacagcacattattcaggtggtccagctacacgctaccgtcgatgatcctcggattgcgtccttaatggccgcccatgtgccggtgattcaagcgatgacgccagcgaatgctacgcaatgtcaagcggattacttattattggataatgcccgtccaggtagtggacaggtgttggattggaatcaattacaatcacagcgtcccgtccggccgtttatcttggctggtggtttaacaccgacgaatatcgtaacggcaatcaacaaggtgtgcccggcaatggtcgatgtggctagtggcgtcgagacggcgggcaataaagaccgtgaaaaaatcaatctgatggtccaacgggcgcaccaaacgggcgtgtcaacaccattattaacagaaattaggaggaattagtatgattaaaaatcaatcacaggcggggcgttacggcgactttggtggtcagtacgttccagaaacattaatgaccgagctacagcggttggatcgcgcctttcaacattaccgacaggacgcgcagtttcaagaagagttgactgacttgttgaataactatgcgaaccggccatcgttgttgtaccatgcacaacgattatcagatcaattaggtggtgctcagatttattttaaacgtgaggacttgaaccatacgggtgcgcacaagattaacaatgccttggggcaggcactgttggcaaagaagatgggcaaaaagcgattgattgctgaaactggggctggacagcacggggtcgcaactgcaactattgctgctttgttcgggatggaatgcgacgtctttatgggtaagaaagacacggatcgtcaagcattgaatgtttaccggatgcaactattaggggccaaggtccacccggtcacgactggttcaatggtgctaaaggatgcgatcaatgcggccttacaagagtggacgcggcgctgtgatgatacagcttatatcatgggctctgcaacgggaccacacccatttccaatgatggtacatgaattccaaagtgtcatcagtgtagaagcccgacagcagatcctggaccaaacaagtcatttgccggatgccgtcgtggcttgtgttgggggcggcagtaacgccattggaagttttgcggcttttcttgatgatacgtcagttgagctgattggctgtgaggcagcgggtaagggtgttcaaacgccgttgacggctgcgacgattgaacgtggtcggactggtatcttccatggcatgaagtcactctttttacaagataaagccggacaaattgccccggtctattcaatctcggctgggctggattacccgggcgtcggaccggaacatgcctacctggctgcgagtggccgggcgcaatatgtgggggccaccgatgaccaagcagtacaagcatttgaactgatcgctaaggtcgaaggggtgatctgtgcgattgagagtgcccatgcagtcgcctacgtacaacaattagcaccaacgatgcaacgtgaccaaactattatttgtacgttatccggtcgtggagataaagatgtggcggcaattgcaaagtatcgaggggtgacaattgatgactgatttaacaacaatttttaaaaatcataaggcgtttattgcttttgtagtggccggtgatcctaattttgaagcgacagttgaccaagttgttgcgttagcagaagcgggttgtgatctcgttgagattggcattccgttctcagaccctgtggctgatggtcccgaaattcaggccgctgatctccgtgcgtttgaccaacacatcacaccccaacgcgtttttgaattggtggtggcaattcgagagaagacaactattccactcgtatttttaacctatgcgaacattgtttatcagtttggttatgctgcctttgcccagcagtgtcaaagtttgaatgtcgcaggcttgattattcccgacatgccactagaagcctctggtgaacttcgaccaaccttagaccactatggtattgctttgattccattgattgcgccaacgagtgatgatgcacgcatcgcagcgattgcccagcaggcgcggggcttcatttatgtcgtatcatcactaggtgtcacggggacccggcgacacatcacgactgatttagcaacactggtggcgaagattcgccatgcgactacgttacctgtcgcaattggttttggtatccatgagccagcccaggcccaggccatggcacaaattgcggacggggtcatcgttggtagtgcagtcgtgcatttgattgcgacgcaccaaccagcgacagcagtcttaagagactatacgcgacggatgcggcgcgcattggatggtcgcacggctgatacagttgactgatcttgtttgttacgatgttgttgtgccgggctacttcgattaaatgctgggaaacgctaggataatgtgctagtctaaaaacagcttactgctttgtgggcgtcgttaataatagttgacgctaaccaagccagttaaattaatttaaggagggctcaacatggcggatgtactgattattattgatatgcaagttggtgtctgtcgcgggtcccaaccggttgccaatttggcaaccgtgattgcgggtattcaatagcgcattacgagttatcgggctcaaaataagccaatcgtgtttgtgcaacatcacgatgctgacttagtcactggttctgccgattggcagatgataccagagttgccaattgaagcaaccgatattgtggttcagaaaacgcacgccaacgctttttatcacacggatttacaagcccaattgacggcgattggatgtcaaacacttgaaatctgtggtgcgcaagttgagttttgtgtggatacgacggttaaaatggctcatgggttaggctaccacctcgaaatggttcgggggttgacgacaacgacggccaattccatgatgagtgcgcaacaaacgattgatttttatcaagatcggatttggaaccaccgtttcttgacgtgggtaacagcatcgggccgtattgacgatttgttagaaaagacgggtgattagttgaaagcattattttttaatgattttggcgatgcgtcggtcctacagtacggtgaggtggcggacccaatcgttactgcaaatactgtattggttaaaacaacgtatatcgggctcaactttgccgacattatcgtcgtcgtggtacctatcatttggaaaagcatcaaccgtacattgatggttatgaaggcgtgggaacggttgtggcagttggtaagcaagtggcgaattttaaacgcggtgattgggtgttattcgttgacgtgccgtttgccaacgctagccttgtcgcggttccagctgatcaggcgattaaagtaccacgggcaatcaatgatcagcaggtcgctagcattggattgcagggcatgactgcggagttcttagtccatgacttagcacaaaaccaaccgcacgatcgagtcttgattcatggcatcagcggtggtgttgggcagctattaacgcaactgctcgtggccaatgaggtggctgtttatggtgtggcgtcaacaccggcgaaagctgaattggcctatcaagctggcgcaaccatcgtttttatgcgccatgatccttgggacacgacccatcataatttttttgatacggtgtttgatggggtcggtaagacactaccagttagtctggcgactaccaagcaccgtgggcgggtcattttttatggcatggcagctggcaatccaccagtaattgatccagtcaagctaatgtccgaatccaagagtttgatgactggtgatttatgggattatttggacagcgcggctgctcgtcagtgccgtgccaatcaattgtttgatgatgtgctcacgcatcgcgtgacgatacgaccagcgacagtctattcattagcagaaggagccgctgcgcaccgggcccttgagaccgggcaagttgctggcaagattttattgcgcccatgaagtacttgaatcgtatttgaaattaactggtttaatcgaatatcaccaaacggcatcgggcagtttttccgatgccgtttttgtggtggattagtagtgcaggctgaatcgagcgccagttagtcaattcaacaattgaattattaaaattcccagtcatgaccacggactgttacactaagtgctaaatcggtcaaatggaagtgtgatggtcatgattcaattagtacgttattcgacgacacggggagcactgaagcaaatacaacagtatcaactggttaatgtgatgtacacggcgacgccacaacaagttattcgtgcttgcaaatctgatttagaacgaacggccgttatgattatgaatggcaaccaattagtgggctttttctgtttgcatgttggtcaaggaccgctcagttacggtgaaacggaagtgaatacgattttgttgcgagccttatctgttgatgatcgctttaagcatcagcgggttgtgtctgacgcgcttgccgaattaccacgttatcttgccagtcattatccgatgattcaaacaatattattagcggtcaatcatgccaatcatgtggcgcaacatttatacctgacccatggtttcactgatacgcatcgccgcatagatggtcgattgggacgtcaatttatttatgaacgcccagtccattgtcccatggatttaaattttgactgaaatttgcttagttagttcagtcaatctagtatttggaatcttatcggaactaggtgcgatactttagaatcgtttgtgtcgttgcgagtgagattggatttaaacggaatctgattgaacggctcgttttacgattagttttctgctagattatgataatacgattagaaaaagtcaatcgtaaatgaagctaatggaagtgatggcaatggtagcaattctttctctaatggttgtcatgggttttatgatgcttggcgagtgggtttccacgcgcagtcgggcctatgttccatccgtatttattacggcactcttatttctagttggtttttggacaattgttcccaaaaacattgtccccgctgcttcatttggcactgcctttattcaaattacccaagccgttttattggttcatatggggacgttgatggatctgaaattgttgttaaaacagtggcgcgcagttgtgattgccctgagtggcgtggttgggacagtggtgctcacgatgggaattggccgtcttttatttgattggcacacgatcgttgccagtgtgcccccgttgacgggggggttagtggctgcctttctgatgacagctggactcaaggcccaacatattaccgcacttgtggcgtttccggtggcaatgtttgtcatgcatagcatgctcggttatccgctaaccgcgtggatgctcaaacgggagagtcgccgactattgcaagtccgacatgtagacgtcacggtcgcgaccgctgattctgccaccagtgcgacagttcaaacaacggcgcaattaccagtgtgcccgctaccaaccgtaccagcgaaggtgaaatcagttcaacctcaattacggcattggcaactaccggctgcttatgatacttcagcttttatgttatttaaagtcgctgctgtgactgggctagctgaatggactgcccagttagcccatggcacgattaatcagtacatcatttgtttagtgtttggtgttatcgcgcatcagttgggctttttagaagatgcggtgttggagaaagcgggcgtctttcactggctgatgtatggtctgctagcttatatttttgccaatctaaacattgttaaaatcagcatgttaagtggtattttgatcccgattgtaacgttgatcgttcttggtgttttagggatgtggattgcatctagcttattggcgcgaccattgggatttagccgcgaaatggcttttgcaagtgcattgactgccttatttggtttccccgcggactatatcgtcacccatgaagtgaccgaaattatggaatcgactgcggaggaaaagcaatatttactagaccagatgttacctaaaatgttagtgggcggttttgcaaccgtctcagtggcgtcagtgattattgcgtcgatcttcttgaaaattttatagggggcttttcagatgatgacaacaactttagcaacttggatgacgaccttgcgccatcaattacacgcacacccagagttagcactgcaagaagtcgcgacgaccgctttaattaagcaaacattgactgagttgaacattcggttggtagactatccgggagaaactggggtggtggccgagattgggcatggtgcgccaatcatcgcgttgcgcgcggatattgatgcactcccaatccaagaagacaatgagttatcctttagatcaacgattcctggtcggatgcacgcttgtgggcatgattttcacacggccgccttattagggggagcgcgattattgaaagtgcatgaggcggatctcaatggtacggtgcgactgatctttcagcctgcggaggaaggacaccgcggtgccaaaatgatgattgataatggtgttctagcaggtgttcgtgcgattgcgggattccataatatgccgaatttaccagtcggcactttagcgatgaagtctggaccactcatggctagtaatgataattttgacgtcacaattctgggccagggcgcccatgcagcgatgcccgaagcaagtcatgatcccatcgtgacgcttggtgaattgatcagtaatttacagaccattcgtagccgaaatattgcgccagacgcagcactggtgctaacgattgctgccgtccaagcgggaacgacttttaacgtgattccaaatacggcgaatttacgaggcacgattcggaccttcaacacggctaaccgggatctagctaaagtacgtttttacgatattgtgcgtgcaactgccaagatgaatcagcaaaccgctacaattgattgggaccgaggaccaagctgtgtcaacaataacgcggcacttaccgctgtactatcacgtgttctgaaagatgattttgatattgtgcctgcccagctatgcaatgccgacgatgattttgcgttatatcaagaatgtattccaggattctatggattcttaggttcaggcggcaatgggaccttacatcaatcaaattaccgctgtgatgacgcaggcctaacctatggcgctcgcttccatgaattggcagctacggcactattaaagtgggttcgagcttgaattgaaagtggtcaatcgacaaagggaagacgctcgaccttgctaggaaactaacatggttgggcgcattttttatggaaagcttctgaatgataagtaacaagcgagtctggtcacaattatctgagtaactaaagtattggttgatacccgacttggtgcaatcattaactgatacgtgcagattcttgttataatatatgtgtattagttttaatattattattttaatgatgaagggaacgaccgctgattgaattttggttgaggcggccaaaggtgattaggatgaaatcaacaattttcgaaaaagctgggctagtatctcttcaggaagttgacaaaccaacattgcaagctgatgatgatgtcattgtgcgcatcgtgcggacttgtgtttgtggttccgatttgtggtcatatgcgcatggtgatgacaaagctgcccattcgatcaacgaaggacatgaagctatcggaatcgttgaggcaattggctcggccattacgacggtcaagccaggcgactttgtcatcaccccatttacccatggctgtggtgagtgcgcggcttgtttggctggtttcgatggtacttgtgatcggcatccgggccacacaaattggtctaatggctttcaagcagaatacattcgcttcacttatggtaactgggcgttagttaagattcctggtcaacctagtgactatacggaagggatgctcaagtcattgttgacgctggcagacgtgatgccgactggttatcacgcggcacggtgtgcaaacgttcaaaagggcgataaagtcgtggttattggtgacggtgccgttgggcaatgtgctgtgattgcagctaagttgcggggtgccgcgcaaatcgtcttgatgagtcgccacgaagatcggcagcaaatggcactggcatctggcgcgaccgcggttgtcgctgaacgtggtgacgaaggcattgcgaaggtacgtgaaatccttggtggcggcgcggatgcggcgttggaatgtgtcggcaccgaagcggccattgaccaagctttaggtgttttgcataatgggggtcgcgtaggctatgtgggtgtaccacattataataaccggccacttgggtcaacctttgctcaaaatattgcggttgctggtggttccgcctccgttacgacttatgacaaacagttcttactcaaagcagttttggacggtaatattaatccgggccgggtatttacgcaaacgtatccattagccgacattaatcaggcttaccaagatatgcaaaatcgaaagacgattaaggctatgattaccattgattaatctcgactaggtaactagtcgcttcaaagtaatcaatcaaaagtcgtttcagtactgattcatcgtgctgaaacgacttttttgatggcaataattaatgttaaaaatcaatcaaacttagttgatttagactagtctttgcgttggcattagaaaaaagatatgcaaccagttgaaccgtgtcattaaagctagctggtcgcacaattgtagtcggcttcgataattaaccgtttaaaaaaacgcattttactatccgggcggacgccagcttgctatactgggtcaaaaatgaggtgagcgccatgcgagtctttacttggatcgtgcgaataattgtggccgtggtcgttttgatgtgtgtcattatgattggtttggcaccccaaacagtggtgacgcatttcaatagtgccgggttggcggattcattcggcagccgctggtggctagtcatgttaccactactagctgtggtgacgggtgaagtcatcattaagttggcccgtcaaaaacggcgcaaactcggactcttgcaactaccgacgctaaccggctttgaaggacagtgtttaggtgtcatggtgggcttcagcgtcctgttgtgggtgatattgcaatcggaagtgcaaggccagcttgtcagtggatttattggtggatggtgattagaaaaatcgattttctgaatagaagcgcttgagacgacgagtttcaggcgctttttaatgccctagttttatcctagtgactgccagcagacaggtgactggttggttgaaactattttttacgaggaatcattaaccgattgaacacattataaactttatagtcaaattgctaacctgtgccagttcgttgacggattatgaccgcaaaaaatggccagttacgaaattttcgcaaaaaaataaagcccgattagagcccagcttaccgggatttgaccactaaaaaatgtaacatactgtaaattaatctgctgaaatcaattgacaagatttggtcggacgattaacttaatgccattcccaaacgccgtgaaaggagcgactaactatgagtgtgttagaagcaagtgaaattatgcaattaatccccaaccggtacccaattttattcatggaccgggtggatgaattaaatccgggtgaatcgatcgtggtgacgaaaaatgtcacgatcaatgagtcatttttccaagggcactttcctggtaacccggtcatgccgggcgtgttgattattgaagctttggcgcaagccgcgtcgattctgattttaaaatctgaaaagtttgctggtaagacggcttatcttggcgccattaaggatgccaagttccgcaaaattgtccgtcccggtgatgtcttgaagttgcatgtccaaatggtcaagcaacggtccaacatgggaacggtgagttgtcaggcgatggtcggtgacaaggcagcctgcacaactgatttaacctttatcgttggtgcaactgattcaaaatagaaaggtggtaatgtcaattcggcgattgtcgtttgggaaagtttttttaaagcattgccgaattgtaaccaaccatgacaactaatttttcgattttagcgagtgctaaggcactgccgacgaccaaagtcacgaatcaagaactaacgcaactgatggcgacttctgatgattggatcaagcagcgaacgggaattcgttctcgccacgtcgcgaccgatgagacaacgacgagtttagctgtttcagttgcccagcagttgttgcagcaaagtcggctagcggcgacggcgattgatttgatcatcgtggcaaccatgtcaccggattatttgacaccggcgacggctcctcaagtacaggcagcgattggggctgaaaaagcaattgcctttgacatcaatgttgcctgtgcgggctttgtttatgggatgcagttggttcaccaatacttacaaccgggtcagaccgctttgttaatcggtagcgagaccttgagtcggttagtagactggcatgatcgtagcactgccgttttatttggtgatggtgcgggtggtctattgattactgctaagcctaatacggccactgggaactggctgggcggtcattacgcgacgtttggcgctgacgggcattatttaacggcgggacagcagtctcaggtgaatccgtggtcaacacggactgatggtgcaggttctaaccgctgggcctttcagatgaatggtcggcgggtttatgactttgccactaagcaagtgccctactcaattgagcaggcgttgatgcaggcacggcttgagtcgagtgatattaaagcatttgtgcttcatcaggccaacgcacgtattgttaagagcgttggtcaaaaattaaacttagctacggaacaattaccgatgaacattgcacagtatggcaatactgcggcggccagtgaaccgattctatttgctgaaatggttgcccaaaagcaagttcaacgtggtgacaagctggtgtttaccggttttggcggcgggttatccgttggtagtgccgtaattgagtattaattgataactgaaatcaagcatttaaaattaatttaaaaattctggaggaatcaacaatgactaaaactgaaatttttgaccaaattaaaaagatgatcgtggaacaattagacgtggatgctgacaagattacgatgacaacgaactttaccgaagacttagcacttgatagtctggacgtttttgaagtgatcgataagatcgaagacgaatatgatatcgaaatcgaaacggatgacgctttagccacggttggtgatttagttgattatgtggcgactcatcaggaaaatagcgaggactaagttatgaaaacggcaatcttattcagtggtcaaggacaacagtttgccgatatgggggccgatctttatcaaacgttaccagcgtaccaagccacgattgacgaagctaatcaagtgttggactgggatctgcgggtaactgctgattggatcgatgatgctcaacggatgccggttgcaattacagcgatgaatatggggttatatcgtgctttaacagcgttgcttaatgagtgtccgaccgtgttagcaggattgagccttggcgagtatgccgcattgattgcagctggcgtcctgccatttgctgatggcttgaagttagttgccgatcgggctagatatatgcaacgagcgggattacagcatcccggggagatggtcgcggcgttgaaggtaacgccggcactggttgcagccgcttgtcaaagtgcccaagcagtgggggttgcgtatcccgctaattacaatctagctgatcaaattgttattggtggcgatgcagctggtattcaagctgcgcgaacctatttaaaaacacacggcgttaaacgggtggtcccattagacgttgcggtggcttcacacacgccgttaatggcggcagcgagtgaggcgttggcgcaacgattacgatttgttaatattgcagcaccccaaattccggtcatcagtaatacgaccgtgaccccctttagccaggaaactgtcaaggaaacgttggtaaaacagttagtatcgccaacgcactttgcggcctgcttacaacgaattgcgacatatgaggtcgatgagattattcaagttggaccggggcatagtttagcaacttttgccaaacaaacattgccgggggtaagggtttggtcaattgaagatgtgacagattggcagaattattgtcaggatactgaggaggtacgtgagcgtggatgaagtgattttagtcactggagctgctaagggtattggtttggcaacagtcaaacggctggcagctcagggggccagcgttattttaaacgttcatcatgaaattgaagcggccgattggcaagcattaacggctgaatatccacggttgacgcaattagttggtgatgtgagcgatgatcaaacggcggctgatttaattgagaccgtgatgacaaattttggtcgcttagatggactcgtgaataacgctggcgtgacccatgatcagttattaacgcggctacacgcggaagatttcatgagtgtgattcaaacaaatttattgggcacatttaatatgaccaaatacgctttaaaagtcatgcagcgacagcgacaaggcgccatcgttaatgttgctagtgtggtcgggttacatggcaatatcggccaggcgaactatgcggctagtaaggctggaattattggtttaactaaaacgacggcaaaggaagcggctcggcgccaagtgcggtgtaatgcggtggccccaggaatgattacgacggccatgacggcacaattgaatgaccgtgtaacggcggctgccttaagtgatattccactcaaacgctttgggacgcccgacgaaattgcccaagcaattgactttttattgcaccaaccgtacttaacgggacaagtgctaacagttgacggtggcatgacgatataagatatgggaggttatccaatgacagaacgagtagttgtgactggaatgggtgcggtgacgcccctcggtaatagtgttgatgaatttttaacggggttattcgcgggacaagttgggattaagcccatcacgaagtttgacgcgacgcccactgggattacagttgccggtgaggttaaggattttcagccagaagaacgaattgaaaagaaattagcgaaaagattggatttattttccgtttatggtttatacagtgcaagtgaagcgatggcgcaagccggactaaatgaagcaaatattgacccagaacgattaggcgttatttatggttcgggtatcggtggtttaacgacgattgaagcgcaagtgatcaagatgcacgacaagagtcccaaacgagtttcaccgttattcgtccctaattcaatcattaacatggttgttggtaatatcgcgatgcaatttaacgcacagaataccagtcaagcgattgtgaccgcgtgtgcgtcggcgacgaatgccatcggcgatgcgtttgaatatttgcgtcaaggaaaggcagatgtgatcatcacgggtggttcagaagcttccgtcaacgaaatcggtattgcagggtttgcgtccctgactgcgttgtcgaaagccactgacccaacgttggcttcgttaccgtttgatcgtcaacgcaatgggtttgtgatgggtgaagggggtgcgacgttagtcttagaaacgttggcccatgcccaagcccgaggcgcccagattcttggtgaagtcgtgggttacggaacgactagcgatgcttatcatatgacagccccccgaccggatggtgctggtgccaaacgtgcaatgcaacaagccgttgcggaagccggcattcagccgcgtgatgtggattacatcaatgctcatggaacagccacacatgcgaatgatagtgccgaagctcaagcaattagcgcgttgtttggtcaagatgtacaagtcagcagtactaaaggaatgacggggcacttattaggcgctgcgggtgcaattgaagctgttgcaacgattggtgctctgcaagcgggtcagttacctgcgaatattggttgtacggaccaagatcctgagtgtccagtcaatttagtaacgccagcaactcaacatcaagccgcaacctatgctttgagtaattcatttggttttgggggccataatgccgtggttgcctttaagaagtgggtgaatgtatgagtatgacggatacggaagcgatgaccgccctgatcaatcagtttaatcaatccagcgctcaagtcatggacgtcaagacgacaacctttgaactgcatttgaataaacaagctgaaactgctgagacaaattcagcgcgttcgcagccggcagtgaccgactctacggtaccagtggtcaaaccgacgactgaagtggcgactcaatcgggaacaacgatggtcacggcgcccctagttggggtggcttacttagctgccgacccgaaacaggcgccgtttattcaggtgggtgatcgtgtcaagtcaggggaaaccttgtgtgtaatcgaagcaatgaaaatgatcaacgaagtccctagcccagttagtgggatcgttaaagaagttttaattaagaatgcaactatggttgaatttgatgaaccattgtttgcaattgaggagacgaccgtttaatggaagttacggatttaattccccaacggtttccgctgcaattattagaccgtatcatagcggtccaaccaggtgtcagcgcaacagcggaaaaattagtcacgattaatgaatggttttttcagagtccgacactgaccggaagaacgatgattcggccagtattattagaaattttggctcaaacgggagttgtggctttactatcgatgccagaacatcatggtaataacgtcttttttggcggaattcggcaggctgattttaagacggatgtgcgcccaggtgaccggttagaagcgatggtaacgttaactaagttgcgtcgtcaaatcggaacaggccatggcgtgattacctgtgctggtcgtgaggttgttagtgctgatttaacctttgtaatgcaagcctgaaggaggtatggcgattgtttaaaaaagtcttagtcgcgaaccgtggtgaaattgcggtccaagttattcgcgcgcttcatgagatggggattaaagcggtcgctgtctattcagtggctgatcaggagagcttatttgtacatctggctgatgaggcggtctgtattggggcgagtcccgtcaaccagtcatatttgaatatgcaagcaattattagcgccgctaatttgaccgggtgtcaggcgattcatccaggctacggctttttatctgagaatgcggaatttgccaaaatgtgtgcggattgtcagttaacgtttattggaccgcgtcctgaggtgattgaccagatgggtgacaaagaaaatgcccggcagaccatgcaacgattaggcgtacccgtgattcccggcagtccatcggtgcttaaggatattgaggcggctatgaaagcggcccatattttaggttacccagttatgatcaaagccgctgctgggggtggcggtaaagggattcgcgctgttagcaatgatcaagatttagcgaaggcctttcgaacagctcagcaggaagctcaagcttcatacgatgatcatcggttgtacttagaaaaaatcattgccccggcgaagcatatcgaaatgcaggtattagccgatcaacaggggcatgttatttatctaccagagcgcgattgttcgctacaacggaatcatcaaaaagtgttagaggaaagtccatgtgcggtcatcacgactgctgaacggaccaaattgggacaattagtggctaacgcaaccaaaaagttgggttatacaaatacgggtacctatgagtttttaatggatcagcagcatcatttttattttttggaaatgaatacgcggttgcaagttgaacatacggttactgaaatggtaacgggtattgaattgattaaagcgcaagtacaaattgcagctggtatgccattaaaaattaaacaggcggatgtgaaaattcatggtgttgccatggagtgtcgcttgaatgcggaggatccgtaccacgattttcgaccgcaacctggaaaaatcacccggttgatctacccaatggggacactgggagtccggattgatgctggtgtggtgactggtagcatgattgcaccgttttacgactcgatgattgccaaaatcattgttcacggtattaatcggaagatggtcagtcgcaagatgcatcgttgtttattggaattgaccatcgatggggttcaaacgaaccggaccttcttagcaggattagttgcagattcgactgttggccgtggtacctataccacagcttatatcgaacaagactttttgaaaggatggttaagtgatgcccaagcgcaagtttcaagcacccactgaacggcagttagctgttcgacgggataatatcccagacgcgttattgacgcgctgtccagtttgtcatgaagattgttatacccaagatctcggtgaattcaaggtatgtccccattgtgattatgggtttcgcttgcctgcttggcaacgtgttcaacaattgacggcgagttttgaagagcgggatgcggacctgagtgcgcccgtcagttttgatgaccctgcatatttagaaaagttgcagcgtgccaaagcagcctcacacttgaatgagagcgtattgactggtattgggacgttagcgacttatcaatttgggttaggtgtcatggaaactaaatttatgatggggagtttgggggcggcaaccggtgagaaaattacgcgattatttgaaacttgtacgacccaaaaacttcccgttgtgatggttactgcttctggcggggcgcgtatgcaagaaggcgctcgtgcattgatgcaaatggctaaggtgtccacggcggttgcaaatcaccgaaaagctggactattgtatattacaattttaactgatccaaccactggtggtgtcacggctagttttgcgatgcagggtgacattatgttgagcgagccacgagcgctcattggattcgcgggtcggcgagtcattgaacaaaccattcaacagacaccacctgcggatttccaacgggcggaaaccttattggccaatggatggttagatcaaattgtgccccgaccagccttacggaaaacactacaacgattattaacaatcactcagggaggtcatcaggatgtctaaagtaacggcctacgaacaagttcaagcagcccgggatgctagtaagattagcattcaaacgttgattgatggcttgacagaggatttttttgattgtcatggtgatcgtcaacgggcggatgatccagctgtaatcgccggcttagcaacaattgctcaacggcccgtcaccattattggtattcagaagggtcaaaatttggccgagaatcaagctcggcattttggctgtgcgacgcctagcggttatcgaaaagcattgcggttaatgcggcaagcagaacaattacggcagccggtcgtgaccttaatcaacacgccgggtgcctatccgggtgttgatgcggaatatgagggacaaggacgagcaattgctgactgtttgttagcaggattacaattgcgagtaccatttttgagtttgattgttggtgaaggtggcagtggtggtgcattagccttagcatgtggtgatcaagtctggatgttggcgaatagtacttactcggtgttatcgcctgaaggctatgccactattttatggaaagaatcgcaacgtgctgctgaagctgcggaaaaaatgcgcttgacgccgacagaattattggcagatgggattattgatcggattattcctgaagtagcaaccgcagcagattgtcaaccgctgaaaacagccattgacgagacattaactgctttaacagcaaagtcggtgacggaactggttacgcaacgccaagcccgttatcggcaattttaaataagtgaggaatgataagtatggatggaattttatcgggtaagaccattgtggtcatgggtgtggccaatcagcgcagtattgcctgggggtgtaccgaggcattaattgcacagggggcccaggttatcttgacttaccaaaatgaccgtttgaagcaaagtttacagcggtttgttgcgccagatgtgccgttaattgcctgtgatgttgctgatgatgacaatgttgagcgggcatttgcaagcattaaacaacagtatggtgccatcgatgggattatccatgcgattgcttatgcggataaagcaacgttagaaggtgattttgtgaataccacgaaagctggatatgatttggcacaaaatattagtgcgtattcgctgattgcagttgcccgagcagctcggccaatgctgaaaccaggagccagtcttgtaacgttgacgtattttggatcagagcgagccgtaccaaattacaatatgatgggggttgctaaggccgcgttggaagcaaatgtgcgttacttggcacgtgaccttggaccacaacaagtccgcgtgaatgcaatttcagccggagcagtcaaaacgttggcggtaacgggtattcatgagcatcagcaattattaaaattatctcgcagtatgacagttgatggagaaccggtaaaaacgcgtgagatcggcaacgtggctgcctttttattaagcaatctctcgactggaatgaccggggacgtggtatacgtggataaaggggtccacttaagttaatgccaatcactcaagttgtctttaaacggcagtggcttcagatgccggtcgatgtttctaaaaaaatgcgacgggtcactcagcgaaccgtgagtcgccaattaattcagcaagtgttatcagtaccattagcttatcatcgactaggacagccgtattttccaagtcagccgcaattaggtgtgagtgttagtcatacgcaccggttagtgatggtggcggtcggcccgggacctctggggattgatgtcgaacaggtccgtccatatgatgtgactgccattcggcgagcctttacatcggcagaatggcagctattacaggctttatcggtgcaagatcgttatcggttagggtggcaactttggacggctaaagaagcggtattaaagttagtgggctgtggcttgacccatgcgccccgccgtgtcgaggttcttgatttagaacttggactagcgtgctatcaaacacagttataccagttgacgccgttagaattgcctgcgacccacgagggatttttggctcgtcccttgtcggttggctgattggagcgcatggttggtattaactttagtgcgctcttttttaagtttagtgaacaatggccactggattttattatcggccgactggttgacctgctattgcaagccttctacgtgctgactaaaagcagttctgagcaagccataattgtgggctcagaactgctttttaatttatccttcaattaatttatctataataatggcaatacaaaattcatccataaccatgaaatcggcatgataacgaccatcatcggaatcatatcggcggtcggaaacatcttgacggcaataatgcgaaagccgctggcaaccattaaaataccaccgaccgctttgaaatctagaatcatgtcaggagtggtcaagggaaagactaggtgagcgactaagaataaagcagtcaggatgattagttggggaacagcaattaaggaaacaactaaccctaagttagcaccgaaaattaccgcagcaaagaagtccagaatcgatttggaaattaaaattgtggcgtcgccgttcatcccttcagttaaagtcccgtaaataccagttccactggcacaaaatagtacgattaccgtgaccattgtctgttcaaaagcctgtttctcaaaagttgctggtgctttgacaaaccgtgaaatgaaacgttgcatcgcggcagcgccgtgattgattgcagttcccaaatggcaaagtaatccaatacctgttccgataataacggcaaagatgaccgccgctagattttttagtggtgcaatcgcgtaaatccccatacacatggaacagattccaaaggacatattcagcccatcttttaaacgttgtgacattcgtttgccggtcaatgcgccgacaatacccccgaaaaagattgcacacacgttagtaataattccaattggcacgcaagccctcctcaatatttaattgataaaaacaacagctattagtttagagcttgtttcggataagaacaattctgaatatgtggtaaactattctaaataggaatagttagaagaaggttaattatggaaacacggaaattggcagtgtttgttgaccttgccacgacccagaactatagtcgcagtgctgaacgcatgtttttgtcacagtcgaccatttcaaagtacattatggctttagagcgcgattggcaggtccaattatttgaacgtgagcatcggcaagtcacgttaacacggattgggcaacaattattgccacgggcccaagcaattctgcgcgaagagcgtcagttacaacaagctctggccgctaataccgctcataatgcgcagtcgctggttgttcagggactaccatctttagcacaataccaggcttttcatattatcacggcatttacgaagcggtatccggaagtgaaattacaatttagtgaggcgagtgtcgatcggttagcgcatgcactggatcatacgaatgtcgacattgtatttacacggattttcggggatcaacccaataattatgacgttttattgaatgagaccgatcagtttgtggtccttgttccgaaagacgatccgttggcgcaacaagctgagattagtctgtcgatgctggcacatgaatcaattttattattgaaagataccatcggtgaagataacccgttgttttcggcatttcaaaaaatgcatacgccacagatggtctatgatggtcaacgaattgatctcattttagaaatgctgaatcagggtgatggtgtctcggttgtcatggcgcggtcatttgatctcactggttttgacaacattaaagcaattccactgacgccaactattcgcagtcagatggctttcatgaagcgtcccgataatcacgctgccgtggttgctaaattttgggcgtttgcgacgaagtattggcaatcggttgcggattaatcgtggcgaataggcaaactttatcacagttaacctggcatgagcattaacgtgggcgatggcatgactagccggccaattagcaggtttcgtcgtttacagcgatatcaatgaaaattattaaagatgacggggtgcagacatggaaccaattcatatttcacagactttatcaattagcaatcaccgtgtgttctcagccgatttgaatgagcacgacacggttttcggcgggaaaatcttggcgactatcgatgataattcatcgattgccgcatcgcgagtggctcgaattgagacggtgaccgtgtcagtcgatcaggtcaattttttattgccgtttcggttacaagactcaatgtgtgcggaatcttacgtttcgggcgttggtcaccgctcaatcgaggtatttactaaaatcattggtgaacacttgaagaccggcgaacggtttttgggattgacctgcttttcaacgttcgtggtgacggaccgtaatattgaattaccactgttagtcgctgataaaccagaatacacgtttgtggctcagggctatcaagagcggcaggccgcccggttagccaaactaaagcgccagcaagactttaatgcgcacattagcgttgaattgccgtggtgaatcgatttaaattgacaattttggtgagacttgttaaattgtaattatcaaatataggaggggtgttttatgtcgggcattcgttagggtgttgttgagcgaaaaaagtgggttggacccgcttagtttcgtgtaccctaatgtgacgaatggcctggcagatagacatgccggacggtttttgcgcacagttgggataagattgggcgtatttttaattcgcagagcgttagggtaagtcactttgcgagaggattataaaaattgacaattaatttaactaaatatggattgacgacggcggttcaagtcgacttgactaaggaaaacggtcaaatacttggccggattatcggccaacatcgcgattggtaccaagtcatcacaacggctggggaacgttcagcacaagttacgggaaaactggcttatgaagcggccagtcccgcggcatttccggcggtcggggattgggtgtacctggcttcatccgctgataatcaggcacagattgaagcaatcgaaccacggcagagtgtcttggcgcgcggtgctgtgaaccaccaagatggccaaatcattgcgacaaatattaataccatctttatctgcatgtcattgaacgcggattttaatgtgcggcggttagaacgttacctgacgattgcgtgggatagcggtgcacttccggtcattgtcttaaccaaggcggatgtctgcacggatctagccactaagctacgggcggtggcggatgtcagtgtcggcgtaccaacgatcacttgttcggccgaaacgggtcagggtttggatgaattgcaaccatacctaacgactggtcaaacggtggcctttgtgggctcttcgggtgtcggtaagtcgactttgattaaccgattgttgggccaggatatcttggcgacgaaatcgattcgtacagatgatgacaaagggcggcacacaacgacgagtcggcaattaataccgctaccaacgggcgcctgcgtcattgatacaccaggaatgcgtgagttacaaatcttcatgggtgatttaaatcaaactttcgcggaaattgccgcattggcgacacagtgtaagtttaatgattgtacccatactagcgagcctggttgtgcggtacgggcagtagttgaggcgggcacggtaacggctgaacggttacaaagctatcaaaaattacaacgtgagatgagctatcaaggactcaattcacgccagttggagcaggctaaaattcagcggatgtttggtggcaaacaagcgatgaagcgtgttaaacaacgttaccatcgcgactgagttgataagtaaattaaagaagctactaaacgggatgtcggcaacggcaccccgttttatttaggacctactttcgttatcgcgtagagtgaaccgagtgacctgttgagcgagataggccggtgtttcaaccatcccattctgttgccaatgaacgagcatattgatgaccgcaccagaaaaataagccgtgtagtacggttggcgaagcgcggtattgcttgaaccgataatacggtcttgtttgatgagtaatgcaaagacggcttcgaaactttgaataaaaatctggttttttcatttttgatcaataacgcatttgtcgctgccatttgttgcatgagagtgaaatattgagtcatcaatacctgcaatttaacctttgattgtcgcggtaattggcgcagatattgaaggatagtctgtttttgataggccaaaataatctgatcgaagttggtgaaattacggtaaaaataggtgcgagaaacctgagcgtgctgacaaagttctgtgattgaaatccgactgagtggtttttgcgacataagctgtagtaaggccgcataaaccgcagttaaattttggcgttttcgtgtttgtgggttcattggttacaacatctccttttttgtaacgtaagtatttatttatgaccattttaccagatatactcccattaacttaacgggaggcgattatgatgaaaaaatcgacgaaggtaattgcaatgatgatgattggcatttttctatgtatgcttgatacgacggttatgaatattgcgttgccagcaattcagacggggctaaatactgatttgacgcacctgtcgtgggcactgaatatttacaccgtcctgtttgctagtctggcgattccactcggtcggttagcggatgtctggggacgcgggcggatgtacttgattggactcgggctcttcggtattggttcactaacttctggattgagtctcagtgtcgggctgctgattactggccgagcgattcaaagtattggtgcggccatcgtcttcccggctagtatgacgattggcattcagagtgttgcactcagcaggcgtacgggggtcattgcaagcttgggtgtgatgcaaggcctagccgcagcgttaggaccaaccattggtggtgcggtcactcaattttgggggtggcggggaattttcttgattaacgtgcctttagttgccgtcgcgttgtgtggttgcttcgcctggctaacatggcgcaccctagccatggccaagcaaagttggacctcggtgggagtgccttggtgatgacgaccttattggcattgacgttggtcctggttaaaggtaatgactggggatggacgagtcgcgtagtcctgagcctgggcgtcactagtgcgctaacattgattgcctttgtctggacggaggcccacgtttctgcgccgatggtcccattagccctatttaaagaccgacagtttaacggggcggcgttagcgaccgtgttatcaggcgtttttatggtgggactattagtcttgatgccgagtttcttcacaaaagttcaaagtaacacggaattgatggctgcgattatgattacacctgcttcaatgatgatttttattttttcaccaatcagtggtttcttgttagcaacgcttgatgcgcggcgtgtaatctttagtggtagtctcgcgatggctacgggttatggggtactcagcctgatgaatcctagtcagtactggcagtttgcattggcggcgttactgattggagcgggctacggcacgattattggaccgattacggtattagcggctggtgattttaccgatgagttattgacagcgtcacaaagtgtgattggtgtgtttcggcagattggcacatcgttggccgtcgccatttttgtgtcagctttagccgctaatttgacaacggctaagacacagatacgaacgtatgcaacgacgacggtcactactctatcaattcctaagcaagccaaacgtgatacgttacacgtggttgaccaccaattagcaactgagcaaaccgcccaaacagcccacgatcccatcacggcggctaagacccgccggatggttgctgccaattatatgcaagtgttaaaagcacggtcattgcaggccgctccagtgcgtatcaaagctcaaattcatcagcaggtggcccaaaaggttcacagtcaagttaaacacactaatcagcgaataaggactgctgcatcagcgattaaggccaaaaccaaaattgagttaactgctgcgtttatgcgcccctaccaagtcgcttggccattcacgctattgctagtgatgacgacctggtgttttgcgggacgggagcggaaaagtggcaagccgagttaagtcacgttgatggggatggacttcacgcacgtttgaatagttgagccggtagggccgcgaaggcaatcgccattactgactttggaacttgccatcgaacttagctttgcgagcatgtgagacgcttatgctataataagggccaaagggggtagtcttgatgaaagaaaaacaagtgtttcatatcaatggctatattggtctagtgttagcgatcgcatttgtgttagttggcggttggctggtttgggccggtgcgactggcgatcattttgcgagtatctttttgggcgcattgctaattattattgcggcctttggggctagttcgctaacaattgtgggccccaacgaggcgcgcgtgttaacattttttggtaagtatatcgggacaattcgtgattcagggctgtttatgaccgttccgttaaccagtaagttttccatttcactgcgggtccgcaattttaacagtgccattttaaaagttaatgacctccggggaaatcccgtggaaattgcggccgttatcgtgtttaaagttgttgataccagtatggcactctttgcagtggatgattatgaacaatttgttgagattcaaagtgaatcagcggtgcggcacgtggcctctgaatatccttatgatacgtttgatgatgacaaaaagattacgctgcggagcaatccgactgaagtttctgaccggttaacggaagaacttcaagaacggctaaatgttgcgggggtcgagatcgttgagacacgcttaacgcatctcgcatacgcgactgaaatcgccagtgcgatgttacaacgccaacaatcttcggcaattctatctgctcgcaaggtgatcgtggaaggggccgtttcaattacggaagacacgatcgcccgtttagagaaagatacggggatgcagctatcagacgataagaaactgcaactgatcaataacatgatggtcaccattatttcggagcggggtactcagccaattgtgaatacttcggaagttaagtaggaacgttgatataacaacaatcaaagttgtagcagtaacataaaaggcgctcatttgctgagcgccttttatactacagttaagttcaaacagtaacaaaaattgacatcatgacccgctaatcttttaaaaagatgctcttttggggatgccttcaatgggtcaaatcgtagctggaacactctttatgaattgctaggtttactttccaacactgctcatggcaattaggccacaccaaccgtgggcaaacattctatttgtagaagttgttaagttggcaattaactgatcttgttcagatgagaaatggtattttttagcgacagccatcacttgaagttgaccgattaattcattgattgcgtcgggtatttgttgataacgcttagtaactgaatctggttggttgatagttgcataggcttggctaattaattttctgatttcaactttttcaattggaactgaagtgtttagctgttctaaaagctgattaacagttgttaaacgcgctaatttctgttgctgtttcatcattgaatcccccagtgtagtgtttagtttaaacaaatgaattagttatagtgatataaatttcacgtcaccactatataggctaacatacaaatgaatactgtactgcatcagcaatttagtttttatgttaatttagttgtccgtttagataggctttgccaataataataattaaccctattatgattaataataaactaacataattaagtggccgacttttgctctgatagtgagtgaaccagccatacttgatccgggtgttaaagacattgatgatgaggccgccaattgcgataatgaaatccatttgtaatacctccatttagtttaagcaatttagatgtaatgactgcagtaaatattgatgctgaacaatctcgatgtttggcaacagacactagttcttggtatttaaaaaaataggtcattctgaatttaacatcagtagtttaagattatcaatataaatattatgaacagcataattttcagtataaataaaactggcagtcattgctattattagaaataccgttggctgttcaatacaggttcagtgaaataaagacaatcaatctttcagaaaatcaaattcaggtatataatgtttcatacacaaaacattatataggagactgttatgctagacaaaatcatttataaaaacttatttagtaaagcgttcgatattactattgaagtcacttattgggatgggcaaattgaacggtatggtaccggcataccagctgttaaagttcgattaaataaagaaatcccaattaagttattaactaatcagccaacattggttttaggtgaagcatacatgaatggggatattgaagtagatgggagcattcaggaactaattgcctctgcttaccgccaaaaagacagttttttgacacataattcatttttgaaacacttaccaaaaatatcacattccgaaaaaagcagcacaaaagatattcaaagtcattatgatatcggcaatgatttttataaactatggttagatggtaccatgacctactcctgtgcgtactttgaacatgacgatgatactttaaaacaggcacaactcaataaagtgagacatattttaaataagctggcaacccagcctggtaaaagattattggatgttgggagtggttggggaacattattatttatggccgcggatgagtttgggttagatgcaacgggtattactttaagtcaagaacaatatgattatacacaagcgcaaatcaagcaacgtcatttggaggaaaaagtgcatgtgcagttaaaggactatcgagaagtcactggccaatttgattatgtcacctcggtaggtatgtttgaacatgttggtaaagaaaatctagggttgtactttaataaaattcaagcgttcttagttccaggaggccgagctttaattcatggcattacaggtcaacatgaaggtgccggcgttgatccatttattaaccaatatattttcccagggggctatatcccaaatgttgctgagaatctcaaacatattatggctgctaagttacaattttcagacattgagcccttgcggcgccattaccaaaagacgttagaaatctggtatcacaattatcagcaggtcgaacaacaggtcgtcaagaattatggggaacgatttgaccgcatgtggcaattatatttacaggcatgtgcagctgcttttgaggccggaaatatcgatgttattcaatatctattagtgaaagcgccgagtggaactggccttccgatgactcgccattatatttatgattgatcttgtcggttctgcggtagtcgtatcgaaatatagctccacaataaacatgtagtttcattgatccctcataaaaacatgagggattttttatgagggatctggaatgatagacaagggcaaccattccagacttgttcagtattaggctggaatcgataggcatagaaaagatttcgggcctctgtgcatcttggtggctatcatgttgtcagggcgttatagtgacaattggtttttgtttctttatgacgtctttcaatcaagttaggccgctattggcatcaacaattatgaaaaagagcgtcggattaacattaatttacatcaacctagtaattaccattttcacaatatggtggactttaagtcccctatcattacatatccaccaatccaactaaggtttgttgaaaattcagtcgccgaatatgccggggaatgaattggcgaatatcatcatcattaaagcctacttgcaatttattacgaccaacaataattggccgccgcaacaactggggttgttcgcataacagccggagcgtctcattgaatgacatatctggcagcttatcagcaattgcgggataactttgtgaacgggtagaaataatatcttccaatccattctcagttaggcacagaatttgttttaactcactaacagtaggggctgcgctactaaagttcttctcctcaaatgcaatatcatgatcccggaaccattggcgggcctttcgcgatgagttacatcctgcttgcgtaaacaatttaatcataattatttcgcctccttgattagtgtttttattatgataattataacttgcttattattgtagcaggttattcataactttgtaaagacctgaacgaagtaatcgtaaaaaattcattattttttcatatttattatcgttcaaataatataaatgttatacgaatcaccgttgattttcatgctgatcaaacgcgcgcagcaagcgtgacgccagcagataagccacttcgtacttcaccgttaactgccacaagaacggcccaagctgatcgtgtgccggggttaaattcgttagtaaattcaggtaacgttgcttttcggccagcgtacaccgttttttaaaatagccccagacgtgctgataagccgttgtcaacgtggctttagttggcgtaatttgttcggcttctgctaataattgttggtagcgttcctgttttgcagctgaccaatcattgtgccgagctaattgtcggatggcattataatgctgctgtgagtgtgccatgacccagtacttttggtaagcccaatcttgttgccattgtgacattgctcccatctcctcaatcttttgatgaatttacaaatattgtaccgtctggctcagaaaaatagaaccaatttacattagtacactggtaacagtcgtaagttttgaaacttagcacaaaaatggcgatagcccagttacccgttggtgcaacttagctatcgccatcaaaacttatattttatgagtactactgttgtcaattaaagttgattagccagaactgatgttacttttcgcctggccgagctgagatcatgagctcacgttgcggataatcttgtggatgttccaacatatcggtgatcaatgtcgccaatgagaataaactaagtggcccaccgctaacagcatttccagctggttcaacaattaattgatccgcttcatcattgtacttgaaaaaatgacaggctagcaatgtatagtccaaatcactattcctgatgactgcggccccggccttttgccccgccacataggtcgtctcaacttcacgactaaacccaaactcgcggtgggctaaggtgtacattgcttctgaaatctgatcatagttgatttgaaactgggtcgtccaaaatagccgtttgaccccaactgcatccatcgcttgcaccaatgccgtggcaaactgcgccgcgtgggtaatgcccaccgttgagaatacgacgtcaatccctcgcagcgcgcgttttaaatcatcaacattgctcgcatccccgattaactgcgtggctaacgagacatcatgctcatgtcggtgatgatccaacaaagtcacgtggtgctgcggcatcacggccactcgacgatacacttcataccccaatttacccgttccaataatcaaaatattcattactgatcacgtcctcacatcacccgctaatttattcgtagcaacggccggaccacgaatgacgccaacagcgcatatccacaccctatggttaatcagttcggtcgcttaaggcttattataccggttccaagatgataattcggtcattatttaaacttaattgtgattcgatgactgattagccttattttgaataacagggtcaatgacagccaccggtcagccctgagtacggatagctattaataactttgaaataaactaatgtcctaccattttatcttggctaggatgaccaagacccaaagacaatttattatgcccgcagttggcgataaaaaaagcatcgctcagttttggataggaaccaatcctaaacttagcgatgcgacacaactctgttcgcgattgctgcgccaactaacgatcaattaccagtttagccgcgagagctcatccatcattgctgaacgccgcggatattgttgctgccaatcatgtacaatcgcctgcacggtcgatttaccagccgggtaagcaagcatccgtttcaagatgccaactaattgttgatactttcgccgagttccagtagtagtagccattttccgcacttcatgatcatatttcgctaatagcagatctgaaaaacgtggtttcaataacggctcataggtccgtaaatcccagagtccgtccgcggccacgaccgcttttaatagcgggttcaataagttttcttgcacgtacagtggtttcaaatcggcattggaattcttcgcgatcgccgtcaacagttgctcgcgaaccgccggccaatccttggtcgggtaactctgcttcaactctgaaaatagcgcctcatccgctggcacatattcagtcaataattgccataattcctgacgatacaattgctgctcacctagttgctgataagcgtcctttagttggcgactaaagtcagctaatacgctcggattgtccgcgaccaactttttgccatcttttagtaattggaccgcatacgcctcatcttgatgttgaagacagaaccggctataaaacaagcggacttgcggtatcgccaaattagaatcacaaaatttaataatttgcttatcaggcacatgagccgcagtcatcatttgtaaatagtgctttagccatttttctatctgccagtcatagtcccagcgatccgggtgtttttgcacggcacggaaccgtttagcggtatacgccagcttggcgtcaataaacgctggcgtcttgaaatacgtgaataataagtcgtcaagcgtatcttcaatgatattcaacgacttcgttaattgtttgcataaccaatcaaacacctgctgctgcacatccgcgtcggcttttgttaagacagcttcccacaagtcgtcactagcactcatgatcatcataatctcaccatcggaatcatcaatgtcgacgtggtcgattttaagcatcagatgcgctaagatttgaaataccaaaccatactcgccgtgatcgaccaacggctgcacctcttcttttagaaaagctaaggcctcatcgccgaaatccgtcgccgcgtcataatcgataaaaccaccgccatccgcgtttgtgtcaaataaatcatcaacactcgcgagatattcaggtaaatctgtcaaaacatcagtctcacccatgaccgtccggaacagttggacgagatgattgtcatgggccaacaccacactcaaaaagtcccgaacttgccgatcagtagcccgctcaaccagcttagtggcagtctgttcaagactgtcgcaactagttggtgctttggaaacttgctgttgactggcaggtttgtcagccgccgtcgcttggtacaaaacggccgccatgtgcttgcagtacggatgaccattggcatacggacactcacacgtgccaccgtgaaagccaccatcagcgagatcaatcaccacgccatagtcctgcgtgcccgtaactattgccgtaatttgtgttttggtccgttttaaatcagtgacatatccctgtaagtaataatcgtacccacgttcagcgattgccgttggaaaatagtcttcccaatccatattgtcactcccgttaacttgtttgtcctaaccatactatggtatggcggattgggaaagacccggcaagcgttttctcatcataaaactccataccgaccctcatttagcatacgccatgtcataactttatctgttgacactaaaaagcttgttttttcaccctggtttgtggctcattggccgcaccaatccatgaccaagtcgccgttgcaagtaggcccacaactgctcgaccgaagtaaacacgatctgatcgccggcttcaacaattggctgattaggatcccacgccgccgtcaaacattgcaccccggccgtatcagctgcttcaaaatctgagcgagtatcgccaacgtacaagagttccgcggcgtctaacgacttagtgcgcatcaattgtcgcagattgtcagctttattaggttgacactcagaaccatacaaccgcgtggggaaataggacgtcaggccagtcacgtccaaggaaatttgacaactcttagccgccttacccgtaatcagagctagcgccaccccttgctgctgcaacagttctaaaagtgtgacgattcccggatacggtgctgacacctgtaaatgtgcgcgagcgtattcttgataaaaggcggccaaagcgaccggccaccgttgaccagccactgctttgaccatcccaacctcatttagcccaaacgtctggacgatagcttgcttggtcagttcgtgctcaacgtacggtgcaacgctacgacgaaagacgtcaatcaccattggaatcgtcggcgcgagcgtgccgtcaaagtcaaaggcgatcatcttaagcatgcggttcaccttgattaatctgccgaatcacacgacaaggattgcctaccgccaacgaattagctggaatgtctttgacgaccacactaccggcaccaatcacggatccccgaccaattgtcacgccgggaataataatcacgccaccgccaatccaacagccatcctcaattgtgactggtcgcgctaacgtctggcaaaaatactgatcactatctggctgccagtccgcacgtaaacgttcatgcagttcgaccggatgggtggccgtataaatttgaacatttgaggcaatcaagacattattgccaatggtaatccgattacagtcgatcaaggtacagttcatattgattgaaacattctgaccaatcgaaatattacacccgtagtcacaaataaatgggctccccaccgaaacattcgatccaatcttggcaaacatagcctgcaatatcgtacgtttctcacttttttggtcataggcgagctggttatactggcttaaaagttgccgtgtacgccgttttagctctaaaaatactggtgcgtgtgcatcataggtctgaccgctcaaactccgctgtcgttcatccatcattaagcacccctttcacttccaagcttaaaaaacgaatcgttactattcaagtcacgattcgtttctttagttatagtcgtttcgctaaggtctcaatcacatagaccacggggacctgggtcgttatattataattaccattaattctctggtgagccaattgatatgaaaaattccaatcggaaagcttagctagcgtggattgagactggttagtaatgcttaagactgcgcaccggcgttgttgaaaatgctgaacaagtgcaattagttctggggtttcgccactctcagataacgcaaaaacgaccgtatcgtgaatctcaaaagtattcactggataattactatcctcaagtccaaacgcaaccttaccagcgttggtaaaacagcgcgcggcatagcgggccaaacttcctgaggaaccaatgccgacaaaaataaccagcgtggctcgacgcaaatacgtgagcgctggcatcaacttacgttcatacgcgctagaattagtttttgcaaaaaagtgtgctagctcactgacgtcgctcttgggctcgtaggtggacaactgttgttgttcacttttaagagcccgtttaaaatcacgataaccttcgaacccatttttaagacaaaaacgcaaaatcgtcgaggtcgacacgtgcaactcgtgagctaactcacgaatgctcatgtagccgaccctatccatattattaataacgtacctgtaaatttccacatcagtttcattatatttttcgagctgctcataactaaacatccgccactaccccccactccaataattcgttgcttggtcaccataatgacctggtttgttcgaccctcattagtcatacaatcgattggacgcgcaactactatcaatagcctactataatcagccactctgatcgcgctagcaaacgaccaacaccgttaccagtaatcagtctttatctatttaagcgcgaataccccgtcattacaagttggtagcaacctaaaaactaggctaatcactgacaaacgtcagctgactaccccagtttctttagcgtcaattttaaaaatgcgcacgcgccagtgcctgtccatcagactgccccactttaatgtgtgggccataaaaaatcaatcagtaaccggtcgacctgcgcattttcatgcaactggctgtgttgcgcatgtttcccagtaatcttaacctcgcgataagaacgcgcacgcgccgcaactaagtaccgtaaagagcgtgatgaagcgttactgacggacccatccgaatgcgtcccatcgcccttatcgccataaatattaaggacccgtacttgctgacgtggataaacgcgccgcaaccctaataactggcggtaggccggtcgcaatttattcggtcggcccgcagcattcaatgtcatctggttaggacggtcgtccatgcctaaaataccattgaaatgtccagcaattgcgacttgtcgcctaagctgcggcaaacgcttattttgcgcattcgccaatagataataggtaatcgccatattacccatggaatgaccaaccatgttaaacgacgtgataccataggttcgttggagcgccaccaccacattttttgcccagcggcccacggttggataatccgaagaccggttattagcaaagttcacttcgacaattggtcgataatcacctgatctaaagtggcctttcaaagtcaccgtcccgtttttagcaaccatcgcgcgtacaatagtttgtgttttgccggctttaacgatagcatctgccatgtgcgtctcagcatggtaactactgccccacccatggaaaaacagtgttggaatgtagcgatgcccctgagtcgtaaccggtttagtcaccccggtcgtcgctgcacgaccacaaccaactaataatagcaataagcctgccatcagtccccataatcgtattcttttcaataacttccccctgaattctatttaatcatctattcactgttagttcggcatttgaatttgcgccaccccgcatcggaaggcgttgtcgcctgagcgttaacgcctattttagcattcaatcaaggctcatgacaggaattacaaccaactaggccggtcacccgccgtaccaggtttatcgacccctaaactgacacgctgataattttcaggatgcgccattaatttaaagactaaatcggcaacacttgctcgtgatacctcagttcctttaaaaggttctgcgccagtcgtcaattcataatcaatttcggcaacatccgttagccaggctggtcggatctccgtataaaccagttcggaagtactaagcaacctcgctgcttctcgaaaaccgggtaggaaaccggcaatggcttgttcgttccacgcgccaaattttcctggcacctcatgatgggcaccgagtgcgctaatgaagatcaaccgttgccgctgagttcgggccattgcggccaaaatgctcttcgtctgggctgctagatcagtcccaccaacattggaatagacgatgtccaccggtgccattgctgtggcaagttcatccgtatcaagcacgttgccatcaatcagcgtgacccgtgcttgctcccgatactgggctaaacgttccgctcgacgtaggaacaataccagttcatcgtcagtttctgctaataaccgttgcgtcagcttcctggcaatcccaccattagcaccaataatcattattttagtcatttctattcacctttcttagatattcgtggcatcacttggaccgtcgcctgccgcggtccacttgctagcatcggcattaaatacggactaccggcatatttttgtcgataagcttggtcaatctggttatttaagggctcatcacaaatgggcacaaaattcaccagatgattgctctcggccaagtgaatccggccagccctttgggttacggccgatcgataccagcgtgagcgcggaccgttccaagcacggataaatagttgctgccctaccacgaccgaccaaatccaggtcggtgtcccgtatgtctgcccatcgctgtaaaatggggagacttgaaaatcatccgccgtgctaaaagcggctaactgtgcgctggaccactgcatcgtggttggtgtggttgctgattccggctgattacttttgttcatcgttaccattcctccattccgacaaaatagtggtgcttaattcagagcacttcggtcaattggtgcccgaccttgatgcttgacacgttattctctgaataaccaactattctgcactaacctcaagtttcatcttaaagcttgacagcaaccatgtcgaattcttatatggtatttaaaattatacttaattgtaatagaaagaagtgctttagatggaattacgagttctacgttattttcaagcagtagtcgccgagttaaatatcagtcgggccgctgaacgcttacacgtctcgcagccaacaatttcacgacaattaaaggatttagaggatgaactgggcgtgaccctatttgaacgcaatggccgtcatatcagtctcacgagtagtggcgaatactttgccacgcaggcgaaccaaatcatcgccttagccgataagacgcttgccaacattaatacagccaaagaaatcagtggcacgattgaattagggagtgccgagatgcgcagttttttgacgattgctcagtcgattaagaaactacaacaacagtatccgaaaatcaggatcaacgtgacgagtagtaatgcgaatcagattcgaaccaacctcaaaaccgggaactttgactttggaatcgtcacggaaccaactgacaaacacgacttaaactttatccatctacccggcgaaagtcgctggggattactggttccgcggcattcgccgctagctgaccatgatcacattagcttagctgatcttgaaggccaaaagatcattgtttctgcacaacacggtacgatcaatcaacttcaggattggtatggtgaaagcacgccaaaattcaccatcgtcgccacttataatttactctataatgcctcgttactagtttctgcgggcgtcgggtacgcgttggggattgatggcatcatcaatacgaaccaatccgatttgattttcatcccactaacacctcgaataaccgcccgcactagcctagtctggactaagggacaacgcttgtcggaagccgccaaaacctttttaacgcaattggcgacagacctgcagcaacaaatacctactgactaacagtatcgactcagctctcaccaatcaccacaacacactgcccaattgatggctgctgaagacgacgcgcatctaattcacgctaattcgaactaaataattgaattgagcacaactaaaatgctaagctaggttattcagtttcagggaggaattatttaaaatgaaagcagtcattattaatcagtacggtgggcccgaagaactccagatggccactatcgaacgtcccagcattgatcaggacgaggtcttagtcgccgttcaggcaacgagtatcaaccccatcgattggaaagctcgtcaagggttgcttaaaggcatgtttgactggcaaatgccagttgtccttggttgggacgtcgctgggaccattgttgaggctggcgcggccgtgaccaactttaaggttggtgatgaagtctttgcccgcccagacatttatgcggatggccggcgcgggacctacgctgaatatgccgcagtcaaagaagacaagttagctctaaaaccagccagtctttcttttgaacaagccgccgctttgccgttagcggggctaactgcttaccaagtcattcatgaccaattaaagattcaagctggcgagaaagtcttaattcaagccggtgctggcggggttggtttaaatgccatccagattgctaagtacctcggtgccgaggttgcgactactgcaagcgccaatcaccatacgctgttgaagcaaatcggcgctgaccacgtcattgattaccacacgacggctattcaagatgtccttacagactacgatgccgtctttgataccattgacgccattgatgagggcttggcaatcttaaagccaactggccgactcgtgacgattgatgggcaaccaacggcggctcaaaaatcccaaggccccactgtctccagctggtggttacaacccaacggccgggagttagccatcttggggcagctcgccgttgaaggacacttacaagtcatcatcgaccaagtctttccgtttagtacggctggtctccaagccgcccaccggtatagcgaaaacagccatagtgctggcaagctcatcatcaacgtcggtactgaagcttaatacggcatcggctccagcctcagccaattgaccaatcgccacattgactgtcaaacgacgcattaaagccttaaaagggcgcttcaagaatccactacgaattcttgaagcgcccttttttaagccccattgcccgaataacgctagttgccacccctgcattttcagccgcttgtcccatctgtgcctcggcgtgatacctattaccgccaccgtggaaaaataacgtaggcgtatttgactgtacatacttcatgcggtgttgttgtgccatacatccactgagccccagtactagcaaaaccactagcaaccctgacagccatttcacttttacttgcatgtcctgattcctacttttgactggaatctattatacagggttcctgtcagcgtaagtcaggctttttcaccaattatgggatgacgaacagtgctttcatcatttggatggcataaaaacagacttggaaaatgaccccaagtctgtgatttaatgcgcctgtgctgctttacgttaggtcaatgcttatcactactattcgaccagttaccacgagctgtaattcgtggtgtttgattgcctcgctgatattcttgttggacggctagttgccccaccaaatttaaatagttaaacggttgattaaaattcggctgaaagaacatatccacgtaagccaaatcatcaatcgtattctgattttgaatcattactgagatcgtgtttgcagcttgggcaatgtcgtgacgactccagaattgcgcgccgagaagctgacgattctgataattataaactagttcaatcgtgactttggccgtcgttggcatataagatggccgccaattgccttgatagacggcgtgtcgtactggtagttctcgtctttgcgcggctggataggtcaacccagttgtggccatcgtgtgatcaaataattgcatggctgaggtggcttgcgttcccatgtacggctgtaaatctccgaaaacattgatccccgccaacgcaccttggcgtagtgcgttagttgccaatggtgtatacgccggctgtcccgtgggattataattgaccacgcaagcatccccagccgcataaatatccgggtcagaggtttgaacataatcattgatcaagatagcaccatggcggtccatagcgacctgcccgcgtaacaattccgtattcggcataaatcccgcgcaaacgacggccagatcaacctcataatcaccctgcgcggtttcaacgatcaactgatcattcgaaccgcttgcgaatccagtcacccgttcattgaggtggatatcgacctggtgatgttgtaagagtttagttgcagcatccgccatttggggaccaagataattattcaaaatatgtgaatgcgaatgaaataacatgacttgttggtccatactagcatagctttccgctaactcggtccccatatatccggccccaacaattgcaacgcgttggttggcttgtagagattgataaagttgttccgcctgctcgtagtttttgcacagtaatactttctcatgatcgatacccataattggtggcacaataactgatgaaccagttgccataatcagcttatcataagtatcatcaaagacttcgccagtctgcatattggcgacctgcaccgttttatggtccgtatcaattcgtaaaacattatggcgggtcttaacttgagcgcctaactgcttcaagtcagccggcgaggtgtaaaacatgtcttccaggtgttggatgacacccgttaagtacaaataaatcccactcgaaacaaacgaaacgttatcattccgctcgtaaatcgtcaccgccgtctccggatgacgtgttaaaatttcgcgtgccgctgccgtaccagcgtgggtactaccgatgatcattactttcatcttaccggatcttccattcttccagatttgccacgtaattagtaagtaggctcaacattaaccactattcaattaattatatcgcgcaccaaatcatttgtatatgtgttgataaaaataaacctagttggcccctcgttcaaacagcctagctttacaaccactgattagctttcgccacacgaatcgcttctaatcgattgtgaacccccaatttgctaaaaatggcggataagtaattacgggtcgtccccgctgacaagtataaattggccgcaatcgtcttcgtgggcaaccccttctcagcttcgaccaaaactgctagttcccgttcggtcaatggattgttgtctgctgacaacatattcgtgactagctcgggcgcatagatggtgcggccggtcatcacagctcgaattgcatcaattaggtcatcactcggactatcttttaacaaatatcccgcgacattggctttaactgctcgttcaaaataatggcgttgcgcaaaagtcgtcaaaacaattactttcgtggctagctgcgaactggccaatcgatcagcaacatccaagccggttatccctggcatttcgatatccagaattgcgacatccggttgcagttcttgcaactcctgccaggcgtttatgccgtctactgcgctacccaccacgtgtagatcatcttctaattccagtaattgggtcaaggcagaattcaacatgctttggtcttctgctaagtataaagttatcatgctgactcactactcctttggtaaagttaagatcaactgggtgccgcgccgactactcgtgatggcaaaggtgccctgtttagcttgcaagcgggttcgcatcccggcaatcccgttggcaccctgacgaatcaaggttccacctttaccgtcatctttcagcttaatctgataaatttttgccgtctcgacaaaatcaatccgcacctcgtgcgcgtgtgcgtggcgcatcacattggtcatggcttcaactaacaccgccgcaaaacaactttggaccgttgtcggccacttggttgcctgtgtctcaccagtggtcgtcgtccagacaccagccgctgctagattacgagtttgggccaataggacttctgtaagcgattgttcatgcaaattattgacaatttcgcgaactaactgtaaattttggcgactggtttgttcgatttcgtccaattctggtgccactttctccggtgccttgacgagcaattttttagctaattccgttttgagtgtaatcattgaaaaactttgtccaagggtatcgtgcaaatcacgcgcgattcgttcacgctcgttacgttccacaattgtttttaatcggcggttagtttggttgagttggcgctgtcgttcaactgaccgcgaaaaggtatacgcgagtatgggtgataacaacggaaaaactaagcccatcacgtcaccattatgccacccaaacacgccaggatattgcaaatagtctcgtatacagccaccaattaaaaaggcataataccctaaagcaaagccataaaattctcgtttaggacgacgaccaagtaaaaagctcacttgccagccgggaaagatgatcataaaattgttagccgcaaataccgcaaacagtcccgtcacaactaactccgctggcatcgtcactgcacgccaatgcggcttctcaacgaccaagatgtacaatacaagaaaaccaccaactaacattagccaaaaccaatcatgccaagatttaacgggtatataagccgcaattgtatacggcaaataggcgagccacacgtagctcgtccattcaatcgtcttcaatttatttttatgatgcgtcaacaacgccattcccccgtttaagtccccgctgaatcacccaactaacaatcactaataggccgcacacccacagcccgataccaagcaaatcgattaattttagtgtaccatgggtgccccagttgaccaacaaatcgttcacataatatgttggcagtcgtttaccaatcacctgtagccagcttggtaataggctaatgggccaccatagaccactaataatggccattggaaaggtaattaaattactagcgacactcaacgtttcagcacgattcaagaatgagagcccaacgcccatgagcaatgtcggcaattgaccaatcagggcaattccaagtatccctagccattgaaccacggtcaaatcaacgtggttcacaacggccgcaatcgcacctaaaataacgaccgttaacgcattcattcccaaactcatcatgccaatcgaacgatagtacggtactaccccgtgtggcgttaaccgtagccaccgtaatagtccccgttcccgatcatgcattagaatctgggcaatactgaacagcgcactgatcgtcccactataaacgatcatactgcccatataagaccgattaaaaagtgcgatttgagccgttgtgccaccggtaaccattacttttgtaaataacaagtaaaaagctgctggcatcaccaaggcaaaaaactgaaacgctgcgttgcgaataatcaaacgccgtgcatcaaatctcagttgagccattaaaattttcatgctgagactcccttcgtcagatgaacaaaaatatccgtcaatgattcacgactaattgagacttgatgcaactcactgattatgggcatcatcgcttccagcgtagcgtcaccgttttcactactcatgcgtagttcgtcgccttgcttagtaaccgcagttactgccgttaaatttgtaaaccgatccgctggcaatctcgtttggcaacgaatctctacttgttgatattgtttttgcaacacggcaaacgagccttgaaagacaaagcgcccgtccttcagcaacataattcgatcagcgatggcttcaatctccggtaggtaatgactggtaatgataatggttttaccagcggccttcaagcgcctaatctgttgccaaaatgtctgttgcgcattggtatccatgccaacggtcggctcgtctaaaaataacaaatcgggatcacctaccagtgccaaagcaaaggtgactcgtcgtaactgtcctccagataacgccgtcaagcgttgctgggcgatgtcttgtagtttcaaggtggctagtaatgcttgccaatcaaattcaggcagacgttgtgccgcagctagccttaacatatcacgcaccgtcacgccttgaattgccatatcaccctgcatcattgacccaatctttaatcgcgccgccaggctaccggccgcttgcccgaacaccttgagatggccctgctgaactcgtttgattcctaataacaaatttaacaacgtcgttttgccggccccattttcaccaatcaagccaacaatctcgcccgccatgatcgtcatattaatatcggtcaaaactgactgttgaccataactaaatgcgaccttagttgcttcaatcaacggtgtcattatccccgcctcctttaatgattatagtgtacgccagcgtaatcgggtcgagtagtcgcgtttgtcataatgatcaggtgacaaatgtcattatttcaacagtattgataagttagcataattctttagaaaataacccagacaaaaagtgagcttctggatttacatcaaaagctcatttgaatcacaattaataacgctagttaccgtgctttcaatacccaatgtgccaattgcgaaacgataacgattccaataacaccaatgatacgcaaactcaatggcagtgttcgaccatcaatgagccaggcagctaacagcagtaattcaccgccaaaaatcacaaatttcattccaacacatccaatccacttttcgctcgtatacgagccaaccaatacaatgtcgattgatctgccattcctaactgagggtggttgctgattaactgtgatttcacttcgtctagttgttactcgcctacgtatgtgcgtctttaatccgccattctccagttggaaaatgattagtccatcaaaagttcaatacattcaaaggtcattccaaccgttaaattagttttggcactgacaccggctcttatgttaaacttaatcaatcacaacgaaaataaggaggtcgaccattgttaattaagtctttcccgcctgccgagcgaacaccgcaattgattagccaattaactcaactctggcgacagtccgtcgacgccagtcaccactttctaacgcccgctgaaatcacaaccattgagcacgaagtccccacagcattacgaaccgttccacaactgctcgttgcagtggatgatcaaaataccccaactggtttcatcggtattgatggttcactagtagccatgctttttatcgccccagccgctagtggcgctggtattggaaccgccttactgcaaactagtattcaggattatggtgccacaacgcttacagtgaatgaacaaaacccacgggtgcgtcaattttatgaacaccgtggtttccaagtcactaatcgccaaccaacggatgatcagagccgtccatatccactattaactatgacttacaactgtgacccattaaacgactgacttgacaaggtcgtttttttataaataatggacttgtccactatttataaaaaaggagtgctgactatcgagtattttagtctaactaaatatattgtgggtatttaccgcgaatccaaaaacagcatcaacacccaactacaggcgctgaacattcgggcgaccgaaagtgacttattactggttgtttacgatcacccggcccaaactcaaaaggacttggctgtcaatctgatgctcgatcctagtttattagctcgaactgttcgtcaacttgagcaacgccaactcgtcatccggtttcgtgatcctgccgatcagcgtagtctacgaattagcttgacaccggctggtgaacaaatcgctatcgccattaagaaaacattgattgactggtggcatgacttcttcgctgctcatccagaagtcaacgagcaagtgtttacgaaccaattacaacaagtttacctcgccttacaagaaaaaagagattgaaatcgtcattgaaaaaattcattaaacactttggagtcctcgtaattggtatcctgtgcatgtcagctggcgtcgcactctctaaattatccttattaggaacgtccccaatttcaagtattccgaatgtcattagcaatattacggcaattccaattggccagttgacaattgcttttattttcattttagttctactagaagccatcgttttgcgccggcagttctcctgtcaaaacttattacaattaattccgggtagcctgttcggttggttcatcgatgcttttgtgcggtttttccatagtcttcctaatcaaacatacatcgagcaactcggacttgtcttaatgggaacggtgctcttatcgttaggtgtctttttagaagtcaattcacacgccattatcatgcctggtgaaggacttccgaacgccatcgcactgatgcatcaactcaagtttgccaaagtcaaagtttataatgatttcattctgattggcatttcactagtcctggcactcagctttactcattctttagcgggggttcgggaaggtaccctcattgcagcctttttaactgggcgactcgtaaatttctttaccgaacatgcaaatcgatttgttgattggatgacaccagccgctgacgcgaacaactaatttccagaattatcaaataaaaacacggtcactggctagtgatcgtgttttttggcttgtgttcacgccaattcgttagtctaccagtgcccgaattttttcagccactaatgcaggtgaacattggtgactggtaagccactcaaatggccgcctaacttggtacaattatttattgaatattttgacctggcactgcaattaaaaacttaagttatcatcgattatctttagatattatcctattaataccggtgaatccgaataccatcacgactgaaagttagcgttgtaagaatccaccgaaaattggtgcaaactcaaactgtttccggttgatccaagctggcgattgctgaattcaattactgcttggaacattaaacaagcgttaatgttgtctcagttgttttgaatctcagtcagacccgaacacgtttcgtcaataaggcattaagacgtgggttgcggcttaaatcagtgtccaccacgttttagcatctacataaaaaaaacgcctgaccaatcagcaccttagctggttagtcagacgtcatcatctggtgattattccaagaaatctttcaattgtttgctacgtgatgggtggcgtaacttccgtagcgccttggcttcgatttggcgaatccgttcacgggtcacaccgaagacttttccaacttcttccagtgtccgggtccgaccatcatcaagtccgaaccgtaagcgtaagacgttttcttcccggtccgtcaaggtatcaaggacaccttccagttgttctttcaacaattcataagccgcggcatccgctggtgaagttgcgtcttggtcttcgatgaagtcacctaagtgtgaatcgtcctcttcaccaattggcgtttccaatgaaacgggttcttgtgcgatcttcaagatttcacgaaccttttccgttggcatgtccatttcagccccaatttcttcaggggttggttcgcgccctaaatcttgtaacaattgccgttgaatccgaattaatttgttaatggtttcgaccatgtgcactggaatccgaatagtccgtgcttggtcggcaattgcccgcgtaattgcttggcgaatccaccaagtcgcgtacgttgagaacttgaatcctttacggtaatcaaacttttcaacggccttcattagccccatgttaccttcttgaatcaaatcaaggaattgcattccccgacccacgtaacgtttggcaatcgaaacgaccaaccgtaagttggcttcggctaattcttgcttggcagattcatcaccttgttcgattcggagtgctaaagcgacttcttcgtcagccgttaacaagtcgacacgaccaatttctttcaaatacatccgcacgggatcattgattttaattccagaagccgagccagcgtcactaagttccttcttagaaacttttttgacacttttgaccgctcgagcatcaggatcacctttttcatcaacaacactaattccagcatcttcaaccttttgtaataatttatcaatgccactagcatctagtttgtaaggcgctgctaatttatctgataattcatcatattgaatgctaccagttttcttatattccttaattaatgctttaacggctttgtcgtattccgtcgttgcttttacctttgccatgtagtagcctcctatttagtatgcatctaccagctgatcggttgcaataccgagccaaccttaagtataccattttcacgcctagttatcagcttgttggacctgctgttgttgccgatataggtcaattaacgccaacgttaactgctgaaccaaatcacgattaccaatctgcttggctgccgttaactcggccttcttactgttgatttgttctaccagcggctgttgattcatgattacgttgactagatcagcaatctcctccttggaagattcactggcaacgtccataaattccaaactcgtgacgaccggctgtaaatctgaatccgtcataaaatccgtaaagttacccaaatcaaattgattatgcgttttaaagtaagcctccgcatacaccaagatttgttgatacgaatcatgaacaaaatgaaaaccagcaatcgccatcacgcgtaaccaaacatcgtggtcattcaacaaacggtacagtaacagccgctctgccttctccacccgacttaacgggccgttgttggtactgccatccaccgtggccgggggtggccctagcggtgcaggtgctggtggcggagctacttgcggttcatccgagcgaccaccaccgccacgtcgaacggcctgctgaccgaccagtgatcgtaactgttgctttaaatcatccttatcaagatcgaactccgccactaattggtttaaatataaatcctgttcgacactagaggacagttgtgctaattgttgcaagaccgcctgtaaataagtcaattgatcgggcgtgttttgcaagttcaaatcatgttttaaatactgcatttcaaatgcagtgggcgtttgcttaccgtcttcaaatacttggacaaacttctcctgcccctgagtacgcaaatactcgtcgggatccatcccatcaggcatttggattacacccagattaaggcgactgttaccacctagcaatttcagagcacgatcagtcgccttttgccccggcatatcgctatcgtaacagacatatagggtgtcggtaacgcgctcaagcatgtaaatctgctcatcagttaagctcgtccccattgatgcgaccccgttctgaataccagaacgataagccgcaatcacatccataaagccttcaaacagcaccaccgacttttgttgtcgaatgggcccccgtgctaagtcaaagttaaataataccgaacgcttgttaaacagcttcgtttccggactatttaaatacttaggttcattaggggattttttgaggattcgacctgagaaagcaatcacccgcccactcgcgtctttaatcggaaacaagacccggtcaacgaagcgatcacgtaagtcccctgcttgattctcaatgaacagtcccgactgccgtagtagttggtagtcagtctggtgttctttaaaaaaatctaacaagagctgattagcaggtgcatagccgataccaaacgttttaatcgtctcatcatccagcccacgctcgtgcaagtacttaagcgccggttcacccagttcagtattcactaaaatatgttgatacatcttagcgctatccgcgtacaactttaacagatcggcttgttgctgatccttaggtgcggccggttgtgactgcgccgtatagctcgccggcaagtcaatgtgcccaaaatcggccaccttgacgactgcttccggaaaagacaagttttcgagatccataatgaagctgaacacgttgcccccacggccacagctaaaacagtgaaaaatctgcttttgctcattgaccgaaaaggacggcgtgcgctcttcgtgaaagggacacaggccaaataaattcttaccggccttcttcaactgaacgtattgtccaataaaatccgcaatgttgactgctgagcggacttgctcaaccttttcctcgggaattcgattggccactttgccaccccatttctactaactaaagtctgacaaaccaaccaaatcattgccgcaatcaaaagccgcatcacgaaacttggatgcgactttgtacgtgcaaacttttacagaatatatagtaccacaagtttgacagcagtgcaataataagttgttcttattagacacttttgtcaaatttgtttgtcgttgaattaaaaaagaagttacagcgtgcttgctgtaacttctctttattatacatggtctgcgtctatttaacgattaattggttcaaatcacccatcacgttaatcatttgggcgatcgttaagagttgcttcaagtgattatcccggactttttcatccttactcatcaccatcgtctgttcaaagtaatcgacaatcaatggtcgtaaggtggccagggccttgaaacggtcgtccatactcatcgctgaggtaaattgcttttgcaattcaagcacagcatcgtacaactgttgttccgcttcattttcaaacaagcttggatcaacggtcaaatcgccagcgtccaacttagctttcgccgtaatccgcaatagacgggtaaaggcttcaattgtgtccttgaactgtggatcatcttgatgggcattcaacacgtcggctgctttaaacatctcacggatatcctgacgacttcctttgataaccgtatcgacgatatcgtagcgaatcttacggttgttaaaccactgcttgacgcgatccgttaagaaatcagcaactggtgccgtttgcttttcgaagtctaagttgtacgtggcatcatgagccactaattccttttgaatatcggcttcgagttgacgaattgggaagtcccaaccctgttcccgtacgatccgcacgatcccaaatgcctgacgacgcaaagcaaacggatcattagagccactaggcgtcaacccaacggcaaagaaactcataatcgaatcaaccttgtccgcaatggctaataccgcgccgaccttggacttaggcaagtcgccatcagcgctgattggcatgtaatgttcacgaatagcttgaccgactgctggatcttcgcccttcaaaacagcatacttgtcacccatgaccccttgtaattcagggaattcaccaaccatccccgtcaccaaatcaaatttatagatttgcgctgcccggtggagttggttcttttcagtctcagtcaaaccaaaccgatcagccaaaaagtcactgataaccatgacccgttgcatcttctcatacatcgtcccgattttatcatggaagctaacctttttgagtcgttccacatattcttgaatcgagtgttgttgatcttcatgatagaagaaagcagcatcttctaagcgcgccgttaacactttctggttacctaaggccacgttttccaagtgatccgtgttcccatttcgaacggaaacaaagtgtggtaataagttatcctcggcatccgttacgtagaagaaccgttgatgatcacgcatcgaagtaatcaagacttcatccgggatcgttaagtatttggtatcaaaatctccagcaaatgcagttggatattccaccaagttattaacttcttccaacaggtcttcattaactttgatttgccagtcgcgttcattcgccaaggctgcgatctgttcacgaatcgtcgctttacgtttagtggcatcagcaatgacttgaacactagctaagtcggcttcataatccgtggccgtggcgatttcaacgtcatgacctaagaaacgatggccccgtgaaacgcggccagccgtgacgtccagaatctgaaccggcaccacttcgtcatctaataatgacacgatccaacgaatcggccggatatacttgaagctgtacgttgaccacttcatcatcgttgggaaattcatcttggtgataacttccttgattccggccgttaatacttcagccgccgtcttaccagccgtaaaggtctgaacaaagacatatggggtacccttgatatccttgaagacgatatcatcagttgacgccccttggcccttagaaaagccgattgccgctttcgtccagttgccatctgcatcctgggcaatcttctttgctggcccccgaacttcttttttcacatcagcctgcttgtcagctaagcctaacacttgaaccgttaaccggcgtggtgttgagaaagctttaacgtcttcaaaatcaagccgggcatccttcaaaaacttgaccattcgttctttaagttgtaacacactcggtgtaacgacgtgggccggcatttcttccaaaccaatttcaagtaaataagttttcgccattatttcgtctcctcctgtgcgtgttttaataacgggaagccacgtttttcacgttgcgccacgaattccttggcaatcgacttcgccatgttacggattcggtctaagtagccggcccgttccgtaactgaaaccataccgcgagcatccatcaagttgaaggtatgactacatttaagacagtagtcgtacgcggggtgaactaagccgttcttaatttgccgcttggcttccttttcatattcatcaaataacattaataataattcttcgttgctatcttcaaaagcgtacttagaattttcgaattctggttccaagaagatgtcaccatacttcacgccatcaccccattcgaggtcaaaaacggagttcacatcttgaatataagatgagagtcgttccaaaccataggtaatttcagaagtaacggggtcaacttcgaggccaccaacttgttggaagtaggtgaattggctgatttccatcccgtcgagccaaacttcccaaccaacaccggcacaacccattgatgggttttcccagttatcttccacgaaacgaatatcgtgttctagcgggttaatgccaagtttttccaagctttgtaagtataaatcctgcacgttttctggtgagggtttcatgactacttggaattggtggtgttggtacaaccggttggggttctccccataccgaccatcagcaggccggcgtgaaggttcaacgtacgccgcgttccatggttccggaccgattgcccgtaagaacgtgtaggggctcatcgttccggcccctttttctgtatcatacgattgcattaacatacaaccttgatccgaccaaaacttttgcaaggttaagataatctcttgcactgataactttttgctcattagtatcctcccaaaattagtgactgaacggctgatggctttgaaacgggggcatcgctatttccatacttagggcacaaaaaaagtcccctgtcgtcgacaataacgacatagggacgattggtttcgcggttccaccctacttctgagtaacctcagcagcttaattacacggtattaaagctccgaaagcgccaattaacgactttgactgaccgtttttcaccatcacggtctcactgtaaatcgaatccgttaaccttctctcatcaacacttaactattcagttctccatcatcatagctgatggccgttcgtttgtcaatcctcattcttccggggcgccaacggttggtaccaactgcccatctgatcgatgaagcgtttagatttcaaccggacgcccactgagttctgatagatctcatccaaaatccggcgtaactccgccgctgtccgcggtttgaccttgatcgaatgaaccttagccaaatccaacacggaaaactgacgtagataaaagatcgcggctggactggcatgcaagcggtggggatccaaatgccagtgctgttgacagagcaaaccaccgtagctttcagaataatctaacggtaaatcactgcgaccgcaaaccgtacaccaacgcaactctggggccaccccaaacggttgcaataactgaatttcgaccacgttagccaccaacgcgggagccacatcttgatcaatcagttgcagtgcactggtcaattgctggtaccaccgtcccaccggttgattatctggaaaagcgacgtccattaagttcatgacgtacgtggcgtaagcgttcaaagcaatgtcttgactaatatgttcaagatactgcaccgacttgacactattaatgtacgaaagaccttgatcacgtaaatcaccaacgtattcccccatcgtgaacggcaataactccgccgccattttgaagccacgccgacgcgcaccacggataaaaaacattttcttgccatactcggcagttaaaaacttgattagcatatcgcgttcccggtaatcccggcgaaagagcaatatgccgttaaaattcgtgaccatttgttgggccatctggatcacctaacgattctaatagtcatcttgccgatagccatagctggctagcaagtcttgacgatccttccagttctcttggacttttacccacagttcaaggtagactttgtccccaagtaagtgttcaatatcacgccgggctaatgagccaatctttttgagcatgcttccgcctttaccgatgatgatgcccttttgtgaagaccgttcaataataatcgtggcctgaacgtgaattttttcttcatcctgacgtttgattgaatcaatcacgaccgccgttgaatggggaacttcttgacgagtcaattcaaggactttttcacgaatcaattcagaaatgataaaccgctctgggtgatccgtaatttggtcggacggatagtactgcggcccttctggtaattggctcttcaaggtggtcagtaattcatcaacgttattgccttcaagcgcggaaattggataaacttccttccacggcaaagcgtctttatactgatccataatttccaaaagatgatctggatggacttgatcaattttattaatcaccaaataaatcggttgtttaaccgttttaagccgatcgataataaagttatctccggcaccacgccgttcgtccgcattgatcataaataggacagcatccacttcacccaaagtagacaaggccgacttgaccatgaagtcgcctaaccgactatgcggtttatgaatcccaggggtgtcaatgaagaccatctgcgtatccgaagtggtataaatcccctggatacggttccgcgtcgtttgcgctttgtcagacataatggcaactttttgcccaacgacccgattcaatagtgttgatttaccgacattgggacgaccaatgatcgccacgaagccggaatgaaatgcttgttgttctgccataattaattcctttcaatcttgcctaagcgttacgcgcagactagcgtaaccaactgacaactaagttccaaactttaggtccaaacaacaccaacccgactaaaacggcaaaggccgcggcaaacactaccgcgcccgccgcaatgtccttaatttttttagctaacggactgaaattaggccccgtaatcatgtcggataagttctctgcgatcgtgttgttgatctcacataaaatgactagaaaaattgctaatgccagccacagccattcgttaacgctcaagtgaatccaccagccagcaaacaaggcaaccgcccccagtgcaaggtgtgttcgcatattacgttcttcaatcaccaccgttttcagcccagtccacgcgtgtagccaggactgccaaaacgagtgattcttaccaacttgtagccggtctggtctatttttcgaggccataagcatccaaaatctggcgttgcaatgtaaacatttcggtttcatctgctggctgaagatgatcatacccatttaaatgtaaaaagccgtgaacaaccaagtaacctagctcacgggcctccgaatgatgcaaaaaggtggcttgttcactaactttatcaactgatatcataatatccccaaggtttagcggcatttccgccgccatctctggatccatcacgatcagatcgtcctcgtcatcgtcgtgcatcgcaaaactaatgacatcggttggccgatcgacgccccgatactgctcgttgattttttgaattgcatcgttattcatcagggtcaccgagacctcggtatcatcccgtaacttcaatatctgaccagcaagatcaattaagtcccggatcaattgcaactgttcaggctgtgcgcccgccgtggtttggtcgtataattctaaatccataagtgccccctagtgttgttccacacgatcgtacgccgtgataatcttggcaacgaccggatttctaaccacatcatccgccgtaaacttgacgaacgcgacattactaataccgcccaaaatctgttcggcttgaatcaaaccgctcttagtatggtgtggtaaatcaatttgtgagatatcaccattaacaatcattttggcgccaaaacctaaccgcgtcaaaaacatcttcatctgggcattcgtcgtattctgggcttcatccaagataacgaaggcgtggtcaagcgtccgcccccgcatataggcgagcggtgcaatttcgataatgccacgatccattaaccgctgcgtgtgttcagcgccataaatatcatacaacgcatcataaattggccgcagatacggatcgactttttcttttaaatcaccgggtaggaacccgagactttcaccagcttcgaccgctggccgcgtcagaatcaatttctcgacatcgccccgttttagggcggcaattgccatcacaacggcaaggtaggtcttcccagtcccagctgggccaataccaaacgtaatgtcacttttggccacggcctgcacatactgccgctgaccaaagttcttgacccgaatggggcgtccacgattgtccttaattaaggtctctgaatagaggtctttaaagtagtctaaagtcccccggtttaccatcttaatggcgctgataacatccggcgccccaatctgaataccttgcttaattaaactcgttaaattatctagtactgcttgcgtattatgaacagcgacttcgtcatcgctactgatcgtcatttgatccccaaacacgtgcaactgcacgtgtaacccatcttcaagcaaagctaaatgagcgtcttctggtcctaataatgcaactgactgggccggatcggcaatgagaaatttttgttcatattttgagttttcggtcaaaaacatggactcctttattgacagatttgatcaccatcatttgatgatggcgcccgcaattagcgtgataaccacgctgatttcagcaggtatttgttagttaatcatagcataaaagcccccatcgaaccagtacaaggacgcctccgcattcgccagcgaggtaccaagcactattttctttcatttgcttaaatcgtcggcgagtcaaccagtgcagcgtttcagcgctgagcgcatacctgtcagtcggtgtcagccaatttgaagcgttcagtcgtacattgttgccagtctaaaaacacaaaaaaaccggagaaaaatttctccggttaaccgttaattcaataatgatttaactgtttggttgatcagcttgccatccgcctgacctttaagtttgggcatcacggcacccatcactttgccaaagtcacctttaccggtagctccaacttgttgaatggtgtcagcaacaatctgttgaacttcttcgtccgacaattgttttggcatgtactgctcaacaattgcaatttctgctttaacgccgtcaactaaatcttgacgacccgcattttcgaattcacttaatgattcgcgccgttgtttcagttcacgtgagagcacgcttacttcctcatcagctgttaaatcatggccaacattaatttgttcattcattaatgctgacttaagcatccgtataacgctgagggcttgcttatcgcgcgccttcatcgcagcttttagatcaccattgagtgtatcaattaaactcattggttttccctcctcgttaggtcattagtaatcaatactaattacttgaaacgacgacggttcttacgcttacgtgctgcttcagattttaacttcttcttcacacttggtttttcgtagaattcccgtttgcggtattcttgtaaagtaccactctttgaaacggtacgcttaaagcgacgaagagcatcatcaagagattcgtttttacgaacgactgtttttgccatgttaaattccctccctccgagctcaaaaagtaaccgttaaattatgcatacttacacataacgcaactgttctagtaaattatacataaattgaaaaaggccgtcaaccaaagtttacaatttccttaaaataaatcgcgaaaagcgacgccagttcggacagtaaatcgttttcatcccccgccagctatgctacactaagactattatcgaaccgaaatgaggttattctatgtcagcaattaaagtctttatcttatctgattccatcggtgaaacggctcataatgtggctctggccgctgccgcacaattctccgactatgacattcgctatcagcgcttcccattcgtccgcaccgactccttgcttcagacggttttggcgcaggcattgaaagaacacgccgccatctttcacacgtttgtcgatcgtcggctcagtaagatcgttaatcaattttgtgaagcgcacgacctgccgtattacgacgtcatcacacccgcgctagatactttttcacagattacgcacgtccaaccgtccaatcaccctggtaccgtacatgcgttaaatactaactacttcgaccggatcaacgcaatcgaatttgcggtcacctacgatgatggcaagaatccaagtggctttttagaggccgacgtggtcttactgggtgtctcacggacctcgaagacccccttgtcactctacttagcgaaccggaacctgaaagtcgctaacttgccactagtaccacaggctcaaattcctgatgaaatttggaaagttgatccaaaaaagatttttggcctaactaacgatcctgaaaggttaaacgatattcgccggcaacggatggtccaatatgggctcaatcccgacaccatgtattccaacacggataaaattaaagccgagctggaatacgctgacaagatttttaagaagattggttgcttagtcatcaatgttgcgaataagtccattgaagaaaccgccactttgattacggaaagtctcaatactgacgaaaccaacaatgactagggtcacaggttcccaactcagcggcgcttcctaggggttccagtctgctagcgcgtgccaccgttcaccggtcagcacgcgtttttttgtgtcattttttcttatcatgatgggagggatacggatcaccagacgtaccacttacacgagctcgacaccaccgtcgacgtgcagcacttgtccagttataaactcattttgcatcaaataaacatacgccgatgccacttcagctggcgttgccacgcgtttcaagggattactagcactgacggccgcggtctgttccgtcaattgggcgtttgatagttgacgccagagaccagtcggcgtccaagtcggtgcaacagcgttgacgcgatagtccgggccaactcgacggccagtccagcgaccatcgtattaatggcttgattaccaacgattgctacggaagcgttatctggtcgacccccagcacccgacataaaaattagtgagccgtgttgattaagatggtcgctggccagctgggccacttgcagattggcaaaaaacttatcttcgatcgtctctcgaatcgccgcgaccgaattgtccaagaacccgccacccatagcaccacctaacattgagacgacgtggtcaaatgcgggttgcgcggcaaaaaatgcttttagctgcgtcgggtcctgtgcatctaacgccgtacctgttaggtggtctgacgcacctaattgcgtcatggccgcgctcacgtgtgcagccgtatgaccgataatctgaacgttagcgccttcctgtaaggcttggccggcaatcgctagaccgaagcccgaagtaccgccaatcactaataaccgctgttgactcaattgcatgtgaatcttcctcctttaaactaaaaaacgataaccggctagcgattatcgttcaattctcattaacgttgttgttcaatatcttcaatcagatgcgtgttaaactccccagcccggagcatggcaatctcatacttgtaaggtggcaattgatgtttcttatcttccccaacatacggcgtttccaaaatcttgctgatatctggtagttgtggatgatgagcgaccttattcaaggcatcaaagccaatcgttcccatgccgatattcgtgtgccggtccttgtgcgcaccttgagggttcttagaatcattgagatggactaccttcaaacgatccaacccaatcacgtggtcaaattcattcaggacaccatcgaaatcatccttaatcgcgtaaccggcatcactcgtatgacaagtatcaaaggtaaccgataacttttcattataagtcacaccgtcgatcatctgtgcgagttcttcaaacgtccggccaacttcagttcctttgccggccatcgtttccaacgcaatttgaacgtgctgttcgggccggatgaccgcgttcagccccttgacgatctgtgcaatcgcaacatccgccccggcaccaatatgtgcccccggatgtaatgtcaattgcgtcgcaccaacggcatctgcgcgttgaatttcttgatagagaaagtcggttgcaaactcaaaatagcctggttttttcgtgttacctaaattaatgatatacggcgcgtgtacgacgatctgacgcagatcattggcctcgattatcggctgtgcttcatcaatcttcagctcgtcgattggtttacgccgtgtattttgtggtgcgcccgtataaatcataaacgtattggcaccgtagccggccgcctcattggcagatccaagcaacatattgggtgccttcatcgaaacatgtgaacctagtctaagcattgttagtcccatccttttcgcgagattactaattcctgtcataccttaaagttgccggatacatatgataccggcatgatcactcattatccaaataaatctgtcaagttattctaagcggttgtggtcacccgtggataaaagtacgccaaggtccgctcaatcgcatgaccgtcattacgcgtattccataactgattaaactgggttaactgtaacggcgcacccggcattgctaggacatgattcaagtccaccaccgtccggactaatggtcccggcgcccagtccctaaaatcagcttgcaggcccacttcttgctcatagtggtcccagtcaaagacataaaaaacgatttttttacaatttggtaacaacgcgtagtcaaacacaactgaggagtagtcactgaccaaagtattagcgaccgtcaacaattcatcggtactaaactcaggtaccaatgtcactaggtccgggtaacgggcttgcaaatcacgttcctgctcggtcaaatggggatgtaacttaataatcaagtgttgattgggccgcaactttaattgcttaaaatcagccggcaacgcaaattgaacaccggctcgataagtcggcgcatacaaaataacttcctgttgtttaaacgccggatacttctgataaatggccgttgcggtttgcatcacccagtcggacttacaataccgatccgaacgaggatatcccaagacccgcatccgcgtctgtgggacgtgataactcgctgcaaaaatcgttcccatcttctcagaaccaaccacgtaatcagtaatctgatcatacacggtctgaaaccgacgccgatcatctgcgggccgctgtgccgtctgtggatcaccccaaccaaatgttttgaccgcgccagcagcatgccagagttgaatcagtcgttgtggggcctgccgcgtcaagccagcggtaaagccataataattatcaagataaacgtccgctgcccgggtaatgacgggaattcccgtcaaggcaaatcgaactgaatcatgaaacggccgtgtcgcaattcccgcctgtgccagttgtgccgccccggtagctgcactcggcaagtaataaacagtcaagcgcccgggaacgcgctggttcaactgctgaataaaatccaaattttccgcaaagctcatcaaataaatcacctgatcatttttgctaaagtgcgctagccacgatacaactcgcaccagccagacataaattactttcttcacactggccatcctttcatttcatcattaattattggtaaagcgtgccctacgtgacaatcaaaaatgtgccagctcaattacgcttaaaaagttcagattggcgtcaacttacttgagccgtctgccttcgtccactaaatataaacaactatttttcaagtctgttccccattagttgttcattagctctgggtctaactgatatggacttatgatccagcaataacacaatgcttgtattatataacagatgcccacacttcggctagtcgggtcactattaatagtggtgtaaaagtcgtctccgaacgcctaatcaaaaagtgcttgcaaacaagtcccgaaagtcctgtttgcaaacacttttaatctgatcatttcatcaaggcttcggctcataaaagtggccgagaatcttgaccgtgtccgaaatgctgacgaaagcgtgtggatccgattcggccatcgccgccttcaactcgcccatttcgtaacgcgtgatgactgtaaataaaatcgttttatcatcatgttgataagcaccttcagcgttgtgcacgatggtaacgccacgacgaatccgattttgaacgctatcgatcaccgttttagggcggctcgttataatcatcacttgcatcttctgttggcgcgtatacgtcatatccatgacccgaccatttacaaacaagccgagtgcggaatagaaggcatatggccacccgtaaacaaagccggccgcaatgacaatgatcgagttgaacgccatgttgatcgtcccgatactccgacccgttttacgacgcaacacaatgccgatgatatcaaggccaccggttgaaatcccgtttttcagggccgttccagtcccaaagccattaaccgcacccccaaagatcgcacaaatgatggggtcatgggtcaaaccaactggggcaatcagtttaatcataatactagacagcgtaacggctaagaacgtatacagcgtaaatttatgcccaatcgaacgccaggcaataatgaacattgggacgttcaaaataaacagtaacgccgccgttgaaatctgaacaggaagaaacttgctcatcaaactattgatcaactgcgcgagcccagtgatccctgaggaataaatatgacccggcgtccagaaatagttcatcgcaatggaaactaaaatggcgtatataaaagcagttgacgctttcacaacatcacgatggtgtttggataactgctgaaaatcatccatgaattaagtgtgctcctttacgttttcgctttcgttattgtaacacgccgatttgcaaacggccggtcttttgcagtattctgctaaaagtctcacgtttctcagcaaactcccattaatcaatccgactaaattccagaacgagccccgctacgatagttattgttagatcacacctatcgcgatgaccagcaactcacgcttagtccactttcggcgcatccgcccactgtgcagcgataaaatcagcgcgaccgcccgcttcttgttccgcgaaaactaccggattatttttataaaaacgttgatggcgtgcctcggccggataaaatggtttggcatcctcaatcgccgtgacgattggcttgttaaaccgttcgctcgcttgcaatgcccgcttggacgcttcggcgattcgccgttgttcggggccgttcacaaaaatgactggccgataattgtccccgcgatcttgaaattgtcccatggcatcggtcgggtccgtttgatgccaataaatattgactaattccgcgtaactaatgatagcgggatcaaacgtgattttgacggcttccgtatgccccgtcgtatgtgccttgacggcttcgtaagtgggattttccgtgtgaccaccggtataacccgagacgacactatcgattccgggttgactgtcaaaaggttgaaccatgcaccaaaaacatccgcccgcaaaaattgctgtttccatgagaattcctccaattaaatattaatataaatttaacactaattaaaaagaacgtccattcctggacgctcttaatatttttattcggttggttcatcatccgttacgggattggtaatattcaagtccaaatcagctaattgctggtcagaaacccgcgatggtgcattagtcattggttctgacgccttggaattcttagggaaggcgatcacttcacgaatgttgtcgttacctgacaataacatcgcgaaccggtctaacccgattgctaagccaccatgaggcggaaagcccatgtcaagggcatccaacaagaagccaaattgttcttgggcacgttctttagtgaattccaatgccttgaacatcttttcttgtaactcccgagtatggatccggatcgacccgcccccgagttcataaccattcaagatgatatcatatgattgggcatgggctttgtgtggatcttcgccatcattcaagtaatgcacatcttcttcattgggcattgtgaatgggtggtgggctggtacccagcgctcgataccttcatcatattcaaacaatggccagtcaacgacccataggtaagcgtattgatcttgatcaatcaagtcaagttccttagcaatcgccgtccgtaagtaacccagcgtgtcagaaaccactttgaaactgtcagcagcaaacaataataagtcacctggtttagcaacagccgcactcgtaatggcttcaaagtcaccatcgttcttgaagaatttagcaaccggaccactaaagccgtcgtctgtgaccttcatccaagctaagcccttcgccccaaaccgtttgacgtactccgtgtacgcatcgatttgttttctggagtagtgatcagcaccgccaggaactgcgatcgccttgaccaggccgccattagcaagtgcattatcaaagactttaaaaccagccttagaaacggccgcgcccatgtctttgagttccataccaaagcgcacatccggcttttcagaaccaaaacggtccatagcttcttgccaagtcatccgcgtaaacggcgtcttgatgtcaacacccttaacgtccttcatgacttgcttgatcaagccttcagtataggactgaatttcttcagccgttaagaaggacgtttccatatcaatctgggtaaattcaggttgacggtcaccccgcaaatcttcatcacggaaacagcgcgcaatttgatagtagcgatcaaaaccggcccccatcagcaattgcttaaagagttgtggtgattgtggtaacgcgtaaaaatgcccttgatagacccgtgaaggcactaagtaatcccgggccccttctggcgtcgacttcgttaagaacggcgtttcaatatcgtagaacccgttggcatcaaaatagctatgaactgcttgggtgatgccattacggatcttcaatccacgttgcatttctggccgccgcaagtccaagtaacggtacttcaagcgcaattcatctgatacgttaatgtcatcttgaatataaaatggcggggttttcgccttatttaagattttggcatcgtgaatttcaacttcaactttacccgtcttcatccggtcgttaacagcgtcagcattccgattaacaacggttccttgcacttcaatgacgtattcgccccgtaactgatccgctaccgccaaagcatccgctgaaaattcctgactaaagactaattgcacaattccttcacggtcccgtaaatcaataaaaatcaaactcccaaggtcgcggcgtttttgtacccaaccttgtaaagtgaccgtttggcctaaataatcctcattgatgagacccgcatatgtggtccgtttcataaacgcttcctccttataaatcggcaaacttgccgttcacactacttatctaaaacttgatgagcatcttgatagatgtccgccatcgcaaccttggtttcctcaccagtagccatggccttcaagttaacgacctgatcagccagctcggtttcgcccaccgtcattgtgtaacgggcattcaagcgatcggcactcttgaactgcgctttaggcttgcggtccaagtaatcccgttcagccttataaccggcggcccgtaatgcttgtaccagcttcaacgtcgtggcactagcggcatcaccaattcccacaacatagacgtccaactgatcatcagttggtacttcaatattttcggcatccatcaacactaatagtcgttcaacgcccaagccaaagccgacacccgaaacttcaggaccgcctaattccttaaccaacccgttgtaacggccaccagcacagatcgtcgtgtagcccttgcctaacgcttttgagtgggtcataatttcaaaaatcgtatggttataataatctaatccccggaccatcgtggcatcaatctcgtacggaattgctaacgcatctaaatacgtcttagtttgatcaaaatgcgcttgagcttccggagacaagtaatctaaaatcgatggcgcatcggccacaaattgttggtcttccggtgccttactatctaagacccgcaatggattcttgtgtaaccgttccttggagtcatcactcaattcatcaaagtgtggttccaaataatcgatcaaggcttggcggtaatcatcacgcgtttgttgatcacccaacgtgttgatgaccagtttcaaatcagtcaagccaaaggtcttaagtaagttatagcccattgcgatcacttcaacgtcgagggcggcactttcactaccaaaagcttccacacctaattggtggaactcacgtaaccgacctgattggggccgttcataacggaacattggtcccatgtaataaactttgtacggtttgagaacctgcggaccgtacaacttgttttcaacaaacgcccggacgacgccggcagttccttctgggcggagcgtaatgtgccggtcacccttgtcatgaaaatcgtacatttccttcgtcacgatatcagaagtgtcccccgctgaacgtgagaagacctcgaagttttcaaacatcggtgtccgaatctctttgaattgataagtcttgaagacggcacgagccgttgcttcaacgtattgccacttttcactatcgccaggcaaaatgtcggcggtgcctttaggccgttgatatctcattaatagttcctcccttgattgcaatcgacaaaaaaagcgcccttgattatttaccaagggcgctattagcgcggtaccacctttttgagtactaattgataacgtctgtaatcacaggcggaacgctgccgttcacctcaaaagcgtctcctcattgcgcactatccggaattctcagcactaccggtctctggttatagtggcgtacaatgctcttactttctctgcggtcgattgattaatatatggttaaagttacacgaaaatcacttaaaagtcaatgattctagttaaaattatctcaagatttcgtcggtctgctgtttttttggtatactatttgcagcacttcaaattgcaattatcttaaatctagttggtgacaaagcatgcaagttttaaaacaattttggcgtcaaatcacggtcacgcttatatttatcggcctcgtgattggctttgtggtgctattggcgactaataacactgcgacggtcaatattgccaacgtcaatattcgtagcggtccaggtatgagttacgcgattgaagacgcgacgtctaagggcactaaggtccacattatgaaacgcaagaacaattggctatacgtccgttacgcggatcataaattcggctggattgccagttggttggtcaatgaacataacagtcagttgaccaagacgaccaaaatctccgaagccaccattgttttggatccgggacacggcggttccgattctggtgcgctctcgagcaagggcaagatggaaaaaacgtacacgttacgggtcgccaaagctgtggctaaaaagcttcgagcagctggcgcgcacgtcattttaacccgtgattcggataaatacgttggcctgagcgcgcgtcccgcaattgcgaataagcttcacgcggacgccttcatcagttttcactttgacagctcaccagaaaaaaatacggcttctgggatcacgacctattactaccataagtccacttcactagcactagccaaggcgttaaacaataacgtctcgaccttgccaattcctagtaagggaacggacttcggtgactttctggtcattcgtgataattcacgaccatccgtattgatggaactgggttatattaatgataagtcggacttcaagacgatcagttctaaaaagtaccctcaagaagtcgcgcacgcggtttacgccggattgagtacctacttcgccaatcaataataatgcggtcggcataaagtctttgaaggtggccgttattccagtgactgggataacggccactttttgtgactattcaatcgatgaagcccaaatcaactgacgcggtttacctaaatgaccatctatttgccagggctttgaccccgtaacagatttctagcgtcatttcacacgcttgcggatcagcgctactaattgttaataacaattaattgcgttacagtgatggtagccgtatttaacatcgcagcaaggaggaagttaacatgcacttaacaaaagcttggctcgcacaactaccactcactgacattcagcaagtacaaccagtgagcggtggcgacatcaacgcagcctttcgaatcgttactcgtcaccaccaatattttttgaaggtccagccgcacaatgacgttactttctttgaccacgaagtcgctggattgcgactacttggtgcagtgactaagacaccgcatgttatcgccagtggcacgatcgccacagacggttacctcttattagattggctagcgaccgggactggcagtcagtccgcacttggaaaagccgtcgccaaagttcaccatcaacaccacgcccaatttggtcttgaccacgatttcacagctggcaagttaccgaaaatcaatcattggcagactgattgggcaactttctatacacaacaacgtttagatgtattagtcaatttgaccaaggcgcaccatttatggtcagaaacgcgtgaaaggcattatcaccacttgcgacaacaactgttgcaagattctcacatgcatacggtaaaccccagcctgttacatggcgatttgtggtcaggtaattacttatttgacacgaccggtacgcccgttttgatcgatcccgacgtgttttacggtgaccgggagatggatctggccatgacgacgattttcggcggcttcgatgctgatttttatcaggcctaccaaacagtctatccgttcgcacccggtatgcaaacgcgactaccaagctaccagctctattatttactggcccacctgaacctgtttggtgaaacgtacgggccagccgttgaccgaatcctcatgcaatattaataaaagcctcgtaaccagggcgtctcaattgagcgacccgaattacgagactttttaataatttgttagacacaatcattagtcaccacaatggttctggcatctagactagtcgacaaaggtcaataagtcgtttaaatccgtaacttgaacttccgggtcactagtcaccgtaatcaggcggtcgatatcaaataaatatccggcaatcccagcattgtgaccggcatcgatgtccaagttgcgatcacccaccataacggcgcggtggcgatcgacctggtgtttatccaataaataattcaacgccgctggatcaggtttacgtgggaatggttgcgcagccgtgaccgcatccgtgaaatattgggccaacccggcttgttccaagtagcgctgggcactttcgtcacgatgggtcatcaaataattgtgaccaccaacggcactaacttttgcaagcacggcctgtgcacccgcaaaagcggcgggcgcgtgctgtaattgtggttcccagcgttgatagccagctcgtaaatcatgccaatcccagccatgctgagtcgcaatcattctttctgcatagccgaccgactgttgacgcatcaactggtacgtggcgtccgccgtaatggtcccacccaactcggcaactgcttgttggaaagctcggaccatggctggataagtatctaacaaggttccatcgaggtcccataaaaactcacgcatctcattcactcccgctaataattgtaatagccaaaaagctgaaagtaccggattggtctttcagcttttacttcaacgttgatcggtgtcataacaaatcgtgaccggcccatcattgaccagggagacttgcatatcggcaccaaattcaccagtcgcaacagtcacgccactggcagctaattgctgattaaatgtatcatacaatttgctagccaattcaggattacccgccgctgtaaaacttgggcgattaccatggcgcgtctccgcgtataacgtaaactgcgatatcgacaagatggccccaccgacttgttgaatattcaaattcatttttccatcggcgtcactaaaaacgcgaaggtttaaaatcttatgcgcgacgtaatccaattcggcttgtcagtcgccatcctgaaaaccaaccaacaggacaaaaccatggtcgatcgtgccttgcactttcccatcaatactaacttgtgcctgctgggaccgctgaacaataactcgcatagcgtcctcctaaaacattttccgttcgacaacgtaaagatcctgaacatttttaagactgtcaatgattcgttggagatgttccaagttgcgaacccccaacgaaacactaataatgaccatcttattgtgatcgaccttaccgttgacattggtcaaaaatttcgtgtgattattgatgactttcaacacatcattgagcataccattacggttgtaaccctgaatttccaaatcagaattgtagttcgttcggtcaccctcgggattttcccactgaacatcaatcaagcgttcgccatttgcttccgcgctcttaacgttcgggcaatcaacacggtgaaccgaaacgccgcgccccttcgtgatgtagccaacaatctcatcacccggaattggggaacagcaatgacttagacgtacgagtaagttgtcgacgccttgaataatcaccccaccagaagaggagactttttgccgcttccgatcctgcttctcctgatcctcattatgatgatctttggctttcttcttcgctggcgcttccgtagaatctgccaaaatcgcttcttcccgttcacgctgccgattagcctcgcgctgtttacgaacatcactcgttaaccggttggcgattcccaccggttgaacgtcaccaaaacctaaggccgcgaacagatcatcttcactaccgtagtgcatcttttgagcgaccgcggtcaccttgtccttggtcatgacttctttcgggttaaattctaagtcacgtaactgcttttcaagcaaatcacgtcccgtaatgatattttcctcacggtcagcattgcggaagaactgtttgatcttattacgggcccgccgcgtgtaaaccaatttctgccagtcacggctaggaccagttgaactagtggacgttaaaatatccacgatatccccgtttttgatctggtaatccaacgggacgatcttgccattgactttcgcaccagtcgtatggttacccacttccgtatggatcgagtaggccatatccagtggtccagcaccctttggtaattccgtcacgtcacccttgggtgtaaaagcgtagacccgatcactaaagaggtcgcccttgacgccctccatgaagtcagcagcgtccttactttcatcctgtagttcgatgatttctttgaccaggttcaacttattgcctgactgggtctcctggacctcgtcacgcttgccttctttgtatgcccaatgcgctgcgaccccgtattcggcgacccggtgcatctcaaacgtccggatttgaatttcgaggggcttgccttcagggccgaccaccgtagtatgcaaggattgatacatattggccttgggcatcgcgatatagtctttaaaccgtccgggcatcggtttccattgtgtatgaatcgcccctaaaacggcataacagtccttaattgagtccacgaccacccggatcgccaacagatcataaagttgactaaactgtttgtgcttatcccgcatcttcttgtaaattgagtagatatgctttggacgaccataaatttcagcttctggtagttccagatcatgaagcgccttttgaatgtcttgaatggcaatctcgatgtacttttcacgatcctcacgccgcgaattcatcaagtggacaatgcgataatactgttgcggattcaaataacgtagtgaaatgtcttctagttcccacttaatcgtgctgatccctaatcgatcggcaatgggggcgtaaatttccaacgtttcatttgcaattcgccgctgtttatcgggccgcaaatgctgcaacgtccgcatattatgcaagcgatcagctaatttgacaatcatgacccgaatatctttggacatcgccaacagtaatttacggtgattttcagcaagctgttctttgttggatttgtaccgaatcttgcccagcttggtgaccccgtcaacaattacggccacgtcatgaccaaacaattcttcaacgtctcctagagtaacaccggtatcttccacaacgtcgtgtaagaaacctgacgcgacggtttcgggatccatcttcaattcagctaagataccagcaacttgaatcggatgcataatatacggttcgccagattggcgatactgatccttgtgcacataagttgcaaaatcacacgcccgtttaactaacgcgacgtgatcactattcatatacttttgaaccatgtccaggacatcctgggcagtccaagtaggttgtttgggcattttatcaccacgacttccacaaagattctatttaataaaaggcacgtgaggttcccacccaacgtgccttgacaaccgttttaacgcaaactcgcgcggggaccagttaacccatatgctaagtaggatatgcctaaatcaactaacgctaagtaatagacatacgttgggaaaaatagatagagcccgacaaaacagcccactgggaacaaccagactaaccagcctgtccgttcagtccgacgaatccaccagccaacaaccgctgccagcacaaagtcaactacaaagagtagccacacaatctgatgaaaccggctaacactcgtaaagcgcagcaaccatggtatcatcaccccaacgacaagcgcaatcagccaatactggccattaaacttacgaaatttttccgtcaaactaactccctcgcttacgctttattgctaaatgactatgattatttattgtacaccaccgaccacaaaattacactagttcgcaccaaaaagaaacgctgcttagtaagtagaggggcgccgtttcagctcgcatgatccgtgggcccaggccgactgccgtcataccagcagcttgtaatgccgctacttcttgtggcgccaagcccccttcaggaccaaaaatcgccagcagtcgttgtggcggcgtcattgtttttaacgtctgcaccaattgactgctctcaccttgcttggccgattcttcccacgctacgacgccggtatcatacggcacgtgcgttaacacctgcgttagatccgtcgcataactcacactaggaatcattgttcggtgcgactgttccgccgccccttgggcaatttttgccagccgggtcaacttacgggcccgcttgttcactgcccatttcgcgaccgcccactgactatcaaaaaatacaaaggcgctggcacctaactcggtaccgcgttgcacgatctggtcaggcttgtcccctttagacaaaccacaggcaatggtcactggtaatggtaattccacgtggggcgtcgtaacggccgtaattgtcgccgtcgctgtccgtccatcgcttttcaccaagtccgccaatacgacttgatgggtcgtcgtaacgaattccgcagtatcccccggttgtgcgcgcatcactttgacccaatgcttgacagtttcacccgttatcgtgaaagtttgtccgacggtcgtcgtaatcggtgttgataaaaagtatcgttgcatttttgtcccccactaatcttcggttgttggtagataggcgatgatgccgtgccagtcgcccatttgcgtatgttgtgtaatttggaagccagcttttttgattgctgccataacgacttggaacttatcatcgatgataccagaagtgatgaagtagccacctcgttttaagttttgccgggcttgcggtaccaatggaataataatttcagccaagatattggcgacgataatatcagcctgggtatcaatcccagctaacaaatcattagccgccacatgaacatccttagcaactggatttaagtccaaattcgtctgggctgacgccacggccacatcgtcaaggtcataagcttcaacggcaccgacccccatcgctttagccgcaatacttaatacgcctgacccggtaccgacgtcaatcaaatgctcgccaccgttaatgacggtctcaagcgcctgcaaacagagcttggttgtcggatgtgtcccggtaccaaaagcgcgacccggatctaatcgcaatacaagctcacctggttgcgctggttggtactcttcccagctcggcacgatcgtcaagtagcgcgtgacccggaccggatgataatactttttccaagcggtcgcccaatcttcatctgacaaggccgtcatgctgacttcatttggggccggattcaacccaaaatcagccaactgactgacacgttgcttgatcgttggaatgacctccggtacgaacaccgtctcaggataataagcggaaatctttgcgccactagtgacgtgtggaattgtcgctaaatcaatgatttcaccataccgatccggctttaaattctgataatccaaggcatcatcaatcttgacgccactggccccggcttccattaaaatattggccactgcttcaaccgcttcgttagaagtactgactgttacttcagtccatttcatatctttatattttcctcccgtaacaagctagagcgccaagcgccatcgcttaagactatcacgttttttcttagtatcaattatataacaagccggatcagcttgacaatcacctggtcatccaaccatgatgttcatgatcgatcgtccggcgagaaatcttggatacgaacggattgccacccaccaagtaccgcaacggtgccgttgtccattcacctttgttgacgattccgattcgtggggtcaccacaacttgttccggttgccgacaagggctcaaattcagcgatagcgtcgccggttgcagtgcttgtccatttaacgttttatccagcccaagcgcctgcattagcttgcccggtccgttggtcaagttcgcaatgggcactggccgctgctgttgcattcgttcaagccccgcatctggttcaattccgcgaatcaagacacattctggtgtaccggcagcttgtgtcacaatattcagtaagcaccaggccctcatttgataaatataaattgttcccgctgattgccagagtgcgtgattgcgcggcgtttggtggttctgatacgcgtgagcgcccgcatcacgggcgccaagatacgcttctgtctctgtgatccaggccgtcaatacgccgctagatgtctgtaagcgcaactgcttacccaggaggcccgccgcaatttcaggggtcgtatgtgtgcttaaaaatcgttcgattgctatcatgcttatttcactcacttctaatagaaaacgggctagcaccctgctagtccgtcctcattcacttagtcattatttgcggtcttcttggttaaatgcttattcaagtacttgatcatgtcggcttcatgcttaaagatccgcggatgcttttgcttgtgcaaccgaaccgcgatctcattgattttgattcgcccggtccaagtatgactgtacttaacgaccacccgattgttgcgatggtccttaccgaatttcaacacgtaaacgctgtcgggcaccatcagcggtctaatatatgttttatcgtagtcataatgtattgatcgcagaaactgtttcgtgcgttttaacatgtcgttgatctctccttcacaatgtgaaattgattaaataataaattaatttatcgttagtatattttaatatctagctattattatagcagactttaaacaagtagtgtaccaatttgccattggtttagcaagtatcgaactttaattcttataaatttgctaaccatttcagaattgtttttgccgcgtatccgggtatggtaaaatatgattaaattagtaaggttatcaatattagggggaatttactgatgatactcatcgaaagaatttatcgtcgtggtcatgaacaattgactacggtcgaccaaatcgaaaaatttcaaaccaacgacggttacgtcacatccaaccaagtcctcgcccgcgaaataggtgcggatagcgaaaactgcttctacaaaaatcaagaaggtaaacgcaaaaaagtcgttgcgaccaaggacgatcagggtacttggcatttaaagaccatcggcacaactgacccggctagcgatggcttattgcaactgccgcacatggatgatgtttggggttaattggtaatcacaattatctgaatcacactatacttgtatctaacaataacgcaaaatggtagtgccatcaatcgatggtactaccattttttattgtcttaatcagttcggcttttcgtcttcgtcagttttcagaaccgccatgaacgcttcttgcgggatttcgaccttgccgacagccttcatccgcttcttaccagctttttgcttttcaagtagcttcatccgccgcgtccggtcgccaccatacagatgggccgtcacgtccttacggtaagctttaatgttcgtccgagcaatgactttagaaccaatcgttgcctgtaccggaatttcaaagttttgccgggggataatcgtcttgagcttagcggcaatctcgcgtccacgcgccggtgcaaagtcgcgatgggcgataaagctcagagcgtcaacttggtcaccgtttaataagatatcgatcttaacgaggtcactggcacggtagccgtctaaatcataatctaacgaggcatagccgcgcgtattcgactttaatttatcaaagaagtcaaaaatgatttcggacaacggaatgtgataaaccacgttgacccggttactatccaagtattccatcgtatcgaactcgccccgtttacgctgggctaattccatgaccgcaccgacgtaatcattaggcaccataatctgagctttcacatacggttcacgaatttccttgatggcagacgcctcaggcatttcagccgggttttccacctttttctccgtgccatccgtcatccggacatgatacgttacggacggcgccgtggtaattagttcaagattaaattcccgttcgagacgctcctgaatgacgtccatgtgtagcagtcccaggaacccacaccggaacccgaagcccagtgcttgtgatgattccgcttcaaattccaacgcggcatcgttcaactttaatttttccaacgcttcccgtaaatcggtgaatttggcattatcagtcggataaatcccagcgtagaccatcggattcatttcacggtaacccgccaatggtttttcggccggatttttcgcgttcgtcaccgtatcacccactcgggtatcctgaatatccttgatgctagccgtaatgtaaccaacatcccccgccatcaaataatcccgtgctaacggtttcggtgaattgacgccgacttccgtgacctcatattcactaccactgttcatcaaccggatccgatctcctggacggacgatgccttcgtgaatccgaacactcagcaccacgccacgataatcgtcatagacggaatcaaacactagggccttcagtggcgcatccagatccccctgaggtgccggaatcttatgcacgatttgttcgagcagatcctcgataccaataccggctttcgctgaagccagaaccgcatcctccgcatcaattccaatatcatcttcaatttctttgcgcaccttttccggttcagccgatggcaagtcaatcttgttgatcaccgggacaatttccaagtcatcatcaatggctaaatacacgttagcgagtgtttgggcttcgaccccttgggctgcgtccacgactaaaaccgccccttcacaggctgcgaggctccgtgagacttcatacgtgaagtcaacatgtccaggtgtatcgatcaagtggaagatataagtctccccatcctttgcttggtagtgtaactctaccgcgttcaatttgatcgtaatcccacgttcacgttccaagtccattgagtccaatacttggtcttgcatttcacgtttggagatcgtatcagtgagttccaggatacgatccgccaacgttgatttgccgtgatcaatatgggcgacgatcgaaaaattccgaatatgttgttgtcggtcttgcattgtcgctttatccattgattttcctactttcttcctaaatcctaatccctacaattataccaagttagtggcgcaagcacaatttttctatcagaccggtccagacatgccgctgtgccactgaataaatgacgtaacaaaaaagtacaagccaatatggcctgtactttttagtagattattcaaaattcttgatttcactcggtttgagtaattgccattctttcgaatagaagtcgtcattaatctgataatgaaccggcttggtcttcttggtcaagaatggatcgaccttttgatccacggccaaccaaccgcgccaaccaagatgaatcgtatcagtcatgaagtagtccttaccaccgtcctgggtcaggtccaagacgttattaaacccttgactcttcaactggtactgaatcttcttgtcaaactgggcaatcatcttcatcgataatccggtataagcagaccagcgctgattgatcggtggaatgatgaacaagacatcggtgtgcgtctttgcaaactgattcaaaaccagttgaaaatcggcaaattcgggtgactttgtgtaattcaagtgttgctgtgaatccttgagccgcttgtaattacgctttaacttcgtgttccagaattgattactgatttcaaggctgttcgagtctgtttgtgccgagccgattttaccagctaactggtctaactgattaaagttatatgtcgctggtaacttattcgcctgcgcattgacagtccgtaaattcttgcccgcaatcccaaagcgtgagaagaattcatcctcactaccaaggacacgtgccttatagttaatatacgtcatttgggcgctcgttggtttaaacccagctgccacccgtgccagggcgccttccaaaatgcgatcagaagaacccgatggcatctgtaacaaacgttgcgcggcatagcggtccattgccgtattctgctcatcctgtaaccaatcaatggtctgcagtggtgagtaatagtacgaaaacgcatctttccgcgttccttgtggcacaaaccattgtggcgaaattacaaagacggccttcttatttgtaatctgctttttcactgactgcatcgcgaaatactgcgtcaacgactgggtccctcgcgcaccaagtagaaatggtcggtaattgcggtgatattttgttgccagtacggacggatgcattggatcaaatcgtgaccattcggaagaaccgaagaatggcacatacccgtcactcaacgcttgtcgttttactaaccgaccttttaatacgttggctgacagggagacggccgcttttttctcggtatctttagaaatatgatttaatccaaatgagaacggtgaaagcagtacggccaataataagacggctgccaaaataattggcccaaaaatcttaaaaaggcgtttggagaccttcattgcaagttctcaacctttgcaacaatcttagccggtgtatcccattctgaccgttgaaattcagagaccggcacttcgattcctaattgattttgaagttccaatagaagttggacggaacccattgaatctaagattccttcgtcaaacaggttaacgtccatattgctagaaacgtcttcccccgttaaatctgctaaaattgataaaaccgttgcttttgtatcatccattgtcattacgctcccttattgtaattatattatggccgggccccaaagaataacgtgttcaagaatcctgagaagatcaagaaactgaaacaaacgacgttaaacgttaggaaaatcgcaaagtattccgtaaatttgttagacggcaactgtgcttgatgttttttcttgtaccgcaaccaagcatcgttgacaaccattgcgaaaccgtggaataacccataaacgatgtaataccacgtttccccgtgccaaaaccccatgatcaacatattaataacgtatgccacgttcgccgttgtgatccggctcttaaagaccttgtgtttcatcataaagaatactaaccgcatgtagatgaaatcacggaaccagaaggataacgtcatgtgccaacgattccagaagtctttgatgttctttgacttaaacggttgattgaagttcatcggggtttcaacacccatcaggtaactgataccgaccgcaaacaaactgtaacccgcaaagtcaaagaataaatccatactataaacgtacatcacaccgactagcgcccaggacatgccgtgtgcttgtaaggccgcgtgttccacgacgggtagcatccgcgtcccaaagatataagctaaaatgaacttatataagaatcccaagaaaatgtagcgaacccctttttcaactaacccaagatacttttcacgggtcgggacactatcataatccttgacgaaccgccgataccggtcaatcggcccggacgagatcgttgggaagaacagtaagaactgcccaaacaacactgaatggaactctttgattaccccatcacgggtctccatgatcatctggaccactttgaaggtcaggtaggaaatccctaagaaaccaataattgaattagcaccgtgtgccacggctggcgtgatcttaacgacagctagtggaataatcgctaagatcacactgacaacgaacacccagcccttattaggcgaatcaggacgttgccgatactttgagtacaaccaaactagtgtaatctgatagatcagataaacaattaacgcgatcccagttcgccacttaacgccaccaaaagtcagcattaagaagataaacgatatcaatgattcataccaatgagaccgccgaccatataacagaccaatcattaacggtaacaacgcgataaagagcagcacaaagtacgttgggttaccatatgggtcaaaagaaatcattctggattaacctctttaatgatcgacttgacatcaatcttaccgttaggcgttaatggcaagctcgtttgatagacgaaccgttgcgggatcatgtattccatcatcattccttgaaggtcctttttaattgccgtggtcaaagcaaaatcactttcaaagtcattcggctttggtaccacgtatgcaatcatttgcgttactttgtgctctttatcgtattttggaacggcaactgcttgttcaatatgctgctgctgtgctaagaagtgatccacttcttctagttcaatgcggtaaccatgcattttaatttggaaatcgacccgaccacgataacggaacagaccgtccgcatccatcgtgccaatatcaccagaatgataggcaggctggccgtctaattcaaagaaagccttggcagttttttcaggattgttcaaatatccctttgaaacggatggtccggcgataatcagttcaccttccgtaccattcggaaccgcctcaccattttcatcaaccaccagcatccgcgtatcagccttggcatagccaattggtagccgatcgtactgtgctaatgcggcatccgtgatttcaatttgcgtgaccgcgacgcaggtttcagttggcccatacgtattgaaaatccgggcatctgggaaccgtttcttgagcgtcgccgccgtcttgtgcgtgagttcctccccacagaacaagaagtgcgttaatgttggtaagttttcagcattaaacttcggttccagcagacaaatgtccataaatgatggggttgagacccacacgttgattggcaacgttggtaatgccgcgaataattgtttgaaatcatccgtcacgctcttcggtaaggcgtacagtgtcccacctaatgctaaggttgggtatacgtccatcacggataggtcaaatgaatatggcggttgtgacaacgaattcggctgatcaggcaagccaaagtcatcactcaacatccagtcaacgtaactgaccaggttgtcatgactgatttggacccctttaggcatccccgtggtcccagaagtaaagataatgtagtaattatcatcaccactgacgatgtgatccgcctgataatcaactggcgtcgcaaagatagccgccaattgatctggggtaattacgggcgtggtcccgacaccggttggcaaatctgcaactgcaatcacggcagctggcttagcaatctcattgatcatcgttaaccgctcatttggtgaatgtgtatcaattggaatatacgcccgacctgatttcacaacgcctaagaaagtcgcgatcatttcaaacgtctgaccaccaaacacaataattggatccttggctggtagatcgagtgtgtcaagatgcgccgccaaggcatctgaataagcttttaattccgcataagtgtgcgtcacaccttgcacatcataaaccacgttattgggttgcgtccgtgcataatcatcaatcgttgtaatgatgttcttaatcataattaaaactccccccaaacaataatgttactgcgttcatttttagaattcgttgtaaataaacttcgcttggttgatcccactataaccgtaaagataaaccaaggcgagcatgacagcaaagtaaaatactgtaagtgcaatgaattgaacgaccggacgttgaaaccagcttttcaactttgcaaacatgccatcacctcctccactaacccaatgtcagttacttgatatcacccttcattaattcggtaaagatcttattagctgttgcctgaatgccggcagacctgcgataataattgctcattaataccaccccggttttcccatccggtgagaggaaaatgctggattcatagccataaccgacaccatgagaacgcaccccattagtcaagttataaataccaccaccgtattcaccagtcgcagtccgggtgtgtaaaatagccacgtttcgtttggaaattagcttacctttaagaattgcactttcaaccttaaataaatctgcattcgacatataaacctgtccagtacctaactcattggccatctgggctttactttctggcatcgttttttcatagccaggagtggtttcactagtccccgagtgataaccagttgttgcatcttttccgagaccatcaataacaaagccagattcggttaaaccaagtttgtcaataaaatgggtcgtaaagtagtgcttgtacgtttgaccagtaagctggcgaataatacccgctagcaaaaggaaattaacggatgaataattagccgttccatttttttctggataataataaacattatgcttggcataatcgattactttagcctcggaagcaaattctttgagaccagtattcaggcgaaagccagtcgtcatgtccaacatttggcgaatggtcgtttggcgtccgtgcttcaaatttggataaaatttggagattggatcagttaacttgagtttccccgcttgtacgagttgcataatgccaaccgccgtcattgacttctgaattgacagaatctgatacttcgaattaacttgattacgcacatgcttagctttattcgcataaccaaacgcatgattgtagatgacatgatcatctttaacgaccatcgcagacccgacaaagtggctcaacttgagtaccttagtcacttgttcatccgtatctttactattcgaaaacgtcgtctggttgaccttacgactcagctggctattcttttgcgccgctttctgattcaatgctttgtcagtttggcgctttttagcaatcgctgcttgccgctccgtatgatgaacatagtagccgccaccagcacccacaatcagcagcccaagcaaaactgtgactaaaagtttgctttgcttcacaatgattgacctccccattagctatcaattacgaactgattggtgatattagctacgccgctaataggacgtaagttcaagttatagtgtaacaacctaacgaccaataacggttaggacggctcaaaaaggacaaaatcctgcattttcgtttactgatccgacatatttgtaacggttttgtaacatcaacgttacctcgccgtgagctaacggtatattacttcacctccttgactaattctagcactcactaatcactggacgacaggataacgaaacagtttacacaaaaaccgggttactgaaaagtcacttaataaacaggccagcatctttgattgactgtactaaaaaagctagacgcacccaccacaaaatgtgatgggtgcgcctagctctttgtatatttctggaattaattcgctcggttaaaccccgcgaagcttgtcaaataacgaactcttgccattgccagcaactgatttgccgctagctttagcaaaggtcttcaacgcttctttttgacccttgttcaagtgcgttggggtttcaatattaacggtaactcgttcgtcgccgttcccattgccacgtaatcgtggtgcgcctttgccacgtaaccggaaagttgtccccgtctgagtaccagcgggaatcttcaacttcacgtcgccgtgaaccgtcttaacttgaacttcatcaccaagagcggcctgaacgaagtcgatcggcaacttgaagtaaatcgtcgcgccatcccgttcaaagtccttacttggctcaactctgaagataatgaataaatcaccataagggccaccattcgttcccgcttcaccttgattttgaagccgcatttgttggccttcttcaactccagcaggaaccgtcactttgatggaatgactttgttcagtatgaccagagccaccacaagtggcacacttgtccttgatttctttaccagttccatgacaaacgtcacaaacttgttggctcatcattcgaccgagtggcgtattagtttgtacctgaatatagcccgcaccatgacatttcgaacaggtcactggtgacgttcctggcttggcaccagagccaccacaagtctcacactgttcctcacgattgtaggtgatggtcgtcttcttaccaaagatcgcatcttcaaacttcagtgtcatctcatactgtaagtctcggccttgttgcggggccgttgggttagaacgccgtgaaccaccagcgccaccaccgaagaaggaactgaaaatatcttcaaagccgccaccgccgccgaagccaccaaagtcttgaccgccgaaaccgccggcgccaccgaagccttgttggccaccagtcgatccgaattgatcatactgtgcccgcttctgggcatcgcctaacgtttcgtacgcttcattgacagctttaaacttttcttccgcgccaggttcatgattcaaatcaggatgatacttcttcgaaagcttgcggtacgccttcttgatttcgtcctgactggcatccttttcaacacccagaaccttatataagtcttgctctgccattgtaacctcctaatgaaccttaattaagtctcattaatactagcatatttaaagcaaaaaggccaaagccacgtggccttggcctttttgttctgccggtgctacttcttatccttgtctttatccaagtcttcgaaatcaccgtcaaccgtgttgtcatcactgcccttggctgagtcggcattgccagcagcattactgtcggcaccgccttgtgcaccctgagcttcttgagcttgttgatacaacttaactgataagtcctgaacgatcttgttcaaatcgtccttcttggccttcatttcgtcaatgttgttatcatcttgagctttcttcaaagcatcgcgagcatctttggccttcttgacttcatcttctgaaaccttaccttcaagatctttcaaagtcttgtcggtcgtgaagatcaattggtcaacttcgttcttcaagtcaacttcttctttacgtttcttatcggcttcttcgttttccttggcttccttgaccatttgatcaatttcgtcgtcagaaagacccgatgaactcttgatagtaatcttttgttctttattagttcccatatccttagcagatacgttaacgatcccgttcttatcgatgtcaaacttaacttcgatttgaggaacaccacgtggtgccgctggaatgtccgttaattggaaacgtcccaacgtcttgttatctgctgccattggccgttcaccttggagcacgtgaatgtcaacggctggttgattatcagcagccgtactaaatacttgcgacttgctggttgggatcgtcgtgttacggtcgatcaacttagtgaagaccccacccatggtttcaataccgagtgaaagtggcgtaacgtcaagcaatacaacgtctttaacatcaccagtgatcacaccaccttgaacagcggcccctaaggcaaccgcttcatcagggttgatagaatggttagattctttgccagtccacttttcaacagcttcttgaacagctggaatccgagttgacccaccattcaagatgacaacgtctaagtcgctagctgataaatcagcatccttcaaggcattttcaacagggatccgtgtcttttcaactaagtcagcagtcaattcgttgaacttagcgcgtgttaacgtggtttccaagtgcaatgggccactagcaccagcggaaataaatggcaaactgatttgggcttcagaaacaccagaaaggtccttcttagctttttcagcagcatcctttaaccgttgtaaggccatcttgtcttttgataaatcaacgccgttgtccgctttaaagccatcaactaaccagtcgataatcttttggtcaaagtcgtcaccaccaaggtgggtatcaccatttgtggataatacttcgaagaccccgtcgcctaattccaagatggagacatcaaacgtcccaccaccaaggtcataaactaagattttttcatctttgtcggtcttatccaaaccataggctaaagctgccgccgttggttcgttaataatccgttcaatgtttaagccagcaatcttaccagcatccttagttgcttgccgttgggcatcattaaagtaagctggcaccgtcacaacggccttttcaaccgtgtcacccaagtaatcttcagcaaaacccttgatgtattgcaagatcattgctgagatttgttgtggggtgtagtccttaccttcgatgctaactttgtatccagcttcacccatgtgacgcttgattgaagctaccgtattcgggttagtgattgcttgccgcttggcaacttcaccaacttgagtttcgccatctttgaacgccacaactgaaggaaccgtccggccaccttcaggagtggtgataatcttaggttcattaccttcaagaaccgctaccgctgagttagtagtcccgaggtcaatcccgataattttattacttgccataaattaacaaacctctttttaatttagtatttttattgattaattactgtgccacaacaaccattgctggacggagggtccgatctttcaataggtaaccccgttgtaagacttgtaccaccgtatcagctggatgatcatcatcaactggcaccgtttgaacagcttggtgaatattaggatcaaacttttcgcccgcagccgcaacttcggtgaccccatgttttttcaaagcatcttgtaaatggccataaaccatttcgacacccttcttcaactgttgggccgcctcatcgtcagccggcgttgctaaggcccgttccaagttatccaaaactggtaagacatcctttgcaagtgcttgaccatcatacttgagcagcgccgcttgttctttcttgttgcggttttgcatattgacgatctccgcctgtgcacgcaataactgatcgtctttcgcatcaagttgtgcttttagatcagtaatttgttgtgttggatcgactgctttcgtttgttcagcttgatcatcagccgcactcgtcgctgcctgtgtggcttcactggcagttgacgttgctgctgaatcagttgttgacgcttgtgaatcttccggcgtcgtccgcgttgatttctttgccaatgttttcatctccctgtccgtcactcgtcaaagtaccggtaataatctaataatttgcgggctaattctcgttggaacgcacccatcagtccaatcatccgtgaatatggcatggcggtcggcccgagcaaggcaatcacaccctgcccgtgctgatcgacatcataagtcgcggtaattaaactgtagttcttcaacaaatcgttggtgatctcattaccgatccggacttgaatccgttgacccggcggaccaatcacattagctaaccggtccgtttggtcaagtaacgagtacaatgactgtaactctttggggctttgctggtccgtatagttgaataaattcagcttaccaccaacatagaagcgctcggaggctgccttggacaacacactgccaaaaatatctaagaagccgtctggatcttgcaaatactgtgcaagcttcaacggaatctcatgcgttaattggcggaggacgtcttgtaacggcaggccaaccagttgatcgtcgatgaaacgaacgaccggttccagctcatcgccggtaatgtcactaggaatagtaaacgtctggttttcaacgtcaccattattcgtcactagaatcgccattacttgatgattccccaacggaacgagtctgaaaccactcaaccgactatctttaagttcaggtcgcaatgtaaaggtcgtgtaacttgtcagttgcgacaagatatccgccgactgagcaacgatctcatcgatcttgtgaaattcaccgcctaatgaatgttgaatcaccttcaagtctttgccatccaccttttcaggctttaggatatggtcaacatagtaccgataccccttaatcgatggaattcgccctgaagacaaatgcgttttgacgattaatcctaaatcttctagtcgggccatttcattacgaattgtcgctgaactgaccttgatcggtagttcttgaactagcgatttggatccaactggattaccgccctcggtatagtcacggacaatggcctttaaaattaggctttgtcgttcagttaacgtgatcatcacctctttttagcacttaacttaatggagtgctaacacaattactaatataacaaccaccctgatgaaagtcaaggaaagacaaagtatttctataaaagaatgcataaattattaggacggcaagtaccaccatgactggatttagtggattgccactaacaattagcactccttacttacgagtgctaatatacaccctcacccttcacaatgcaagcatggtgcctagcagcctaatcgatgtttccaacgggcgcccgcacactctctgccaacgttttcgcacatcgtcgtcataaaaaaagtctcgcgagctactaactcgcgagacttttttggcttggtcacatgcatttttcaagctaaggtgccggccttaacggcaatcagtagtcaactgatcaacgctcagctttattgatagcatgatcaatcgcttcgttatcaaattgttcttgcaggtacgcctcattgtcgatcggtaagtggacgtgaaaatcagcaaaatgttgaactttcagtgtcgcctgttcgacctcaaagcccagcaaatggccacccaattgatgatcgttacttaggaaatgtaagtgaaagccaccgactgtggcaccttggaacagatgcggtgcatagtagccaataatcgtgccatcaacgtgttcgccggtgaattccggttgtgtcgtcgtagccgcaaccaaggttttgtacggtggctcctggcgaggtgcgacccgcgtcttgatttttgcaaaggtcccgtcgacccgaatagccgcaaacacgttagttagccgataatcgcggaccacttgctgttcaaagtcagcttgggtggttggcgctaattgcgcgctgatgtcaggcttctcaaagtgtactgatgcaaatggcaacgtctcttcaggctgaatttcacgaatcttgccatcctcgcgtgcttggtaggcgtgaccgtctaaaataatcacttcgccattgaggccgtctagtgtcccgatcccggtgtcaccatgagtcaagagttcaccggccgtaatcgtcccgtcaaataagcccggaacgagtaagcctagtgtgccgtgttgaaaaattgttgttgtgtccattcattgtgcctccaaacgatctgattgttgtgcaacttgaatccggggtgtcaccacaaagggatgcgccacataatagtcacgggtgttttgttcatcccgctttaattgtgcaaccaaggcatcagccccggcaaacttgatttcaccacgcatccggtgcccccaacgcaccgttaaattgtgtccatatagatccccctgaaaatctaataagtagatctccaccgtgattggtcggtggtcaccaaacgtgacatttcgtccaactgaggccatccccatgacccagcgtgtcccaatctgcaccatcgtcgcgtagatgccgattccaggaacccgggtattgggtccgtgcgcgacattcgccgttggaaagccgagcgtgcggccccgtgcttcaccatgaactacttcgccagccgtttcgtattgataaccgagtaaccggttggccgtatcgatatcaccagtgtccaaagcacggcgaatccgcgttgagctgatcttttcggcgtctagttccgccttagggacttcaatgatttcaaaccgatcatgaccataatcattcaaacgttgcatgttcgcaatatcagccggtccgtacgtgtagtcaaaaccagcaaccaccgtttgcgtgtgtaagccaacgatcaactgatcgacaaacgtttgggggggcatggccccgaccgtggcgtcaaagtgaagcacatatagaatgtcaacgccgagctcactcattaacgccgtcttctgatcaatcgtcgttaaataacggacttgctggggatcagtgtgtttaaaaacaactgacggatgctggtcaaacgtcatcactgccagttgggcgtgttgggcctgagcagcttgccgggccgttgcaacgacttgctgatgtccgcggtgaacgccgtcaaaaaaacctagggccaatacgatcggtccgtcaggaatctgaccagacgccacgggatactttaaattaatcacctgcatgacaaaaactccttaattgaccgcaaacattttgaacggcttgtaccgctgttcgtccggtcgataactatatagacattttaggctgttttggtaaactaacgcaaccatcgtgttcgcatctggatcagtttgttgtccttctgccgcagtaataaaagcaccgtttttaacgcgttgccactgttcatccgtcaacgtgacccgcggatactgccctaaggctttatcgatgggcgctagtagtgcccccgccgtgccagcttcaacatgggccgcgatttcctcgaaggtcacggtctcatccaaagtaaaaccgccactctttaaccgggtcaggtcgctcatcaccgcgggcaccccgagcactttaccgacatccactgcgagtgtccgaacgtaagtccccttactacatgcgaccgtaaaatagattgtctgcgtctgggttgacggatcataagtagcggcttgacgttgcttgaagctgctaatagtgacgtgtcgttctgggcgttcgacggtttcaccgttgcgagcataatcatataaacggcgtccatttacttttaccgctgaaaacatcggcggaatttgcgtaatggccccggtcatccgtgccagcgcagcatcaatttcgtcatttgtgaacggctctgtgaccgcctggcgtgcaatctcctcaccatctaaatcttcagtggtcgttgcaaatcccagggtgatgctcccttgatattctttaccggaagcgactaaaaattgaacaactttagtcgcattgccgatacaaattggtaaaacgccatccacatttgggtccagtgtcccagaatggccgactttgcgggtctgatagagtcgtcgaatcttagcgacacagtcgaaactcgtcattccgcgaggtttatataatggtagaatcccgttcaacataaaaaacgccttcaatcatttaaattcggtttctagtggcaaccaaccgctttgccacgtttcgatcgttcttaatcgacggttttcagtataccacacctcaccactatgtaagcggattatcacagaattcagggagctggcgtcgtagcgacgacagccggaagctggtcctgattcgacaccatcaacctggcatgctgacaacgactacccagttgtcgcaatcgttgattggcaaaccatatcgcacccgaaaacacttcctatagatcaatggtcgctccacaaaagcgttggtggtggtgggccgtacgaccggtcaatgaggcgtcagatgggttggcaccttttccacagttgccgaacgtactttacagacattaaaaaaccgtgcggcctctttcgggacatgcacggtcatcagcatttatttttcattataaaaggtcaccgccactgtctgcaaatgccactggcagtgacgccacaattggcgacgtcatcagctttcaagcttgaagcgccgtagcttgctgattcaaccattcctgaatctggtgcgcaatctgccgcggtgtcaactgatcagtggcaatcgtcaaatcggctaccgcggcgtataaggattgacgccgccgcttcaaggcaatcagtgcatccggatccagttcattgactagtggccgactgctgtcatttttgacccgattaatcgtagtctggtccccagccgtcagccagatgacgggcaccgtactttgcttcagactgattgcattcattgcaatggtcggcgtcccgccaccagttgataagaccccaggtgttttgagggcctgcagcagcgtttgatgctccatttgccgaaagtacccttcgccacgctcagcgaaaatcgtcgtaattggtcgtcccgctcgttgaacgatcaagtcatccaaatcagcgtgttccgttgctagcccagctgctaaaagccgtccgaccgtggttttaccactacccataaatccaattaaaattgcgcgcatgctaattcctccttgcaatctgataaccagcatctgttaataatgacgcggcttgcgtttgcgtcttcaaatcactaaatgtcagttgtaatacgccatcaacgtcttcacgaatctctaagatatgaatattgactatgctcagttgagcttgtgctaaccgccgagtaacatccgcaatggcccccacttggtcgggaacgttcaaaaacaaatcataaaagttaggaaggccgcccaaacgttcaggccccaagtggtcacgagtcaccttggccgtcgcaaaaaaatcatgcagcactggctgatcatgggcactaatggccgttttgatgcggattaactggtcaatataatcctgcaattgattggttattagttcagcgttagtcatcaggatagccgcccacatggtggggtccgaactggcaattcgcgtaatacttttaaaacccccggctgctaagcgtaatccgagtggtgaatccgccaaagccacctgagtctgatcaactagtgccgcggcgacgatatgcggcaaatgacttagctgaccaacaatccgatcatgctgcatcgccgtgaccgtcaaccatttgacgtgggtcgcttgtaaccatacttgtagtcgttcaacggctgcctggtcggtccgtcccggtaccaaaaagtaaaaggcgttctcaaacaaattggcacgaccagccgtcacgccggatttgtgcgaaccagccattggatgaccgccgatgaaactcactccttgctgctggagggcgtgaccagcacgcatcacaaccagtttggtactcccgacatcagtcacgagcaccccagcttttagcgtcagcgtcgccagttgatgcaggtcagccacgatcacatctaccggtcccgctaaaatgattacgtccgcgtcgcccgcgaccgctgccaggttgggcgcactcacatcgattattccttgctggcgcgcgtagctcaggctagccgcatcctgatcgattccaatgattcgcacacccggatgaccctgtttgatgcctagtgccaacgaactaccaattagccctaagcccttgatcaatattgtcgtcatcttcacacctcctggtttaaacgtgccaaatcttcgaagaatgtcgggtatgaaatattcactgcttcggcatccaccagttcggtgggaccgccgacccgtaacgccgagatcgccatcgtcataccgattcggtgatcgccatgactagctagtggctcggtcggttgctgccaagactggcgaccatcgatcataaagccatctggtcgtgccgtaatctgaacgcccagcttttggagctcagtcacgatcgtcgcaatccgatccgtttccttgacccgcagttcagctgccccactgatcgtgctaatgccatccgcggtcgccgctaacaacgcgactagtggcaattcatcaatcacggccggaatttcactggcggtgacttggaccggatgcaattgggcaaaccgcacgtctagcgtaccaacaggctcacccgcaccgagcttacgatcgaccgtcacccggccgcccatccgttgcaaaatgcttaggaaccccgttcgtgtcgaattcagtcccacgtgggtcagtcggacatgcgaatttggaataatcgttgcagcggtcatgaaaaatgccgccgaagaaaaatcgcctgggatcgtcaatgattggccaatcaagtttggctgcggatgcaccgtgattgtccgatgatcagctgccgtttcgatttgaccaccaaataaccttaacaagcgctcggtatggtcgcgagtcggtaatttttcaacgatcgtactcggtcgatcagcttgcaaagcggccaaaatcaaggcgcttttgacctgcgcactagcgacctgcatctcggtacaactaccatgcaaagtccggccagtgatcagcataggtaagtgtcctccggttaattgcaactgcgcccccatggcctgtaacggttgccgcactcgttccatcggccgttgactaagagacgcatcaccaaccagggtcgtctcaaacggctgaccagctaacagcccggctagcagtcgcgtcgctgtccccgcatttcccatgtctaatgcctgttgtggttgggtcagcccgcgtaaaccgcgacccctgatcataacggtcgtgccagtccgctcgattggcacccctaactgctgaagcgccgtcagcgtgctgagacaatcggcagctggcaaaaaatgatgcaaagtcgtcgtcccctgactaattgcccccaggatcagacctcgatgcgatatgctcttatcgccgggtacgcttaactcaccgtgtagaccacaggttggttgaatgcttagttcttttatcattaatcatcatcacctaatttatttgatagacgcaccacaccatcgaaggtgtcaaacgtgcaagttctcgttcgtgagtcgtcagtgtcacgtttttttcattagttaacacgtatgccgcttgattacgctgataagcctgatatgctaaatacttacttgcgaccgtttgcactgtgacctggtgcacgaccctcgttaataattgggcagtcgctgcatgcgtgtaaccaatctgattgtcggcccccacgcgctggagcacgacgagtggatcgagttgcgtcataaaacaatcggtcaacgtcaattggggcaacaacgcatagtggatatcgccccaactggcattcagggtgtccgatttgaacgcggctggtatcaccagttggtcaccagaataggacgttaaatgggttaaaatggcttcaaagcttgggtgttctacaatcactgcttgtccctgccagttgcgatgattataaacttgcgcggccgcataactatccgtggcggtcggtcctaaggtatgaatttgcataggccctcctaatattgacggagttcttcgcgatatgccgctacagcttgttgcaggcgcgctaagttactgccatcaaatgcggccgtcaatgctcgcgttagttcgattgcgaccacgctttcgaccacgatcgaggcgggaacgatggctgtcgtatctgaacgctccacgctcgccttttggctgaccttggtcgcgatatccacactttgtaatggcttgtaaagtgtcggaatcggcttcatggcagccttaacaacgattggcattccattagtcatgccgccctcaaagccgcccaaatgattggtcagccgtgaccagccagcatgttcatcccaactaatttcatccattacctggctaccataatggctggcagctgcaaatccatcaccgatttcaacccctttcatggcgttgacccccatcactgcggcggctaattgaccatctaacttggtatcccaattcgtgtaactgcctaaacctgccgggacattttcgacaacgacccggataacaccgcccaaggtatccccagccttcttcgttgctgtgatcagctcatggatttcgggcactaaggtcgcatctggtaaacgcaaatcattttgtataatttgggcctgcaattgttcaacggatagtgctaaatcggacgtcacttgctcaggcccaatttgttgaacgtagccaactaggtgaatgtccagctgcgctaataattgcttacagatctgaccaatggccacccgcatggcagtctcacgagctgaggagcgttctagcacgttacgtagatcacgatgaccgtacttcatgccccccactaagtcggcgtgccccggacgtgggcgcgtaacttgtcgcaaggtattggttgccgtagccggactgactggatccatgattgcggcccagtgcgcgtggtcgcggttcagaatcgttagtgcaattggtgagcccagcgtaacaccgtgccggacgccaccggtgatttgaatggtgtcatgttcaatctgctggcgattaccgcggccaaagccaccttgtcgggcagcgaggcccgcattaatagcgtcaatatcaagttgtaagccagccggaataccggtcagcaccccggtcaactggggtccgtgcgattcacctgcagtaacgtaattaatcatgatcaatctcctccttgtgtaaatccgtctgataggcgcgcgagttatgcataattgcttgataaatggcttgtaaataaggggtatgcgcggtctgggtactcttcaccgcaacttgttggagcacccgttgttcccgttgttgatctaatactggaagttgctgcgcttgcttcaactccccgatggcggtcaccgtatcaaaacgttgattaagtaatcggacgatttgctggtcaatgtgattgatacgctggcgttcttgactaagtgtggtcgggacatgtaccgcccacacagccagggcgacaaaggcgagaccactggcagcaataactaaatcaaagcgcatcgcggtcgcgatactttgtttggacaaccacccagtcacgagcggaatcgtgaaggaagcaatactgccaaacgtgaagtaaatgccagtgattcggcccttgatgtgaggatagattttgataaataagttgaggccgacctgcatcacaccacccgcagccgtaaaaccaaacccgaaagctgccagcatcgataagcccaccgccggactataacagatcagcgctaacgccaacaacgagccaccattcattgctaatagtaatttagtttccgcaacccaccgccgtagtagccagaagattacgaggacacctgtaatcgaaccaatgcggtaaagcgagagcaaccagtgcgctaacactgacgaaaaatgaaacgtcgtggtggcgaacaagctgacccactgcgtgtagagaatcatgagtgccatcgaagtataaccatagccagctaagccaagtgtcgccaagtaacgacgagacttcggttgccgcttggaagcagctacgacagcctgatcagtttgatttttgaccggaaactgttgccgatttaacaggacggcgttaaccactaagatggcagctgctagcatgaatgaccagccgtaccagatccgctgggcttcaaagttcgcaataagcagtggcaacaagaattcaccggctgacatgaaggctttcagtaacacattagctgacccttgccgaccacccatttcaataaacgtcgggtaggttcccgcatccaacgcggagttcgcaataccggccaaaattgccaagccataagccagttgaatattcgtgacaaatgccatacccacgaagaaagtgaagtagcaagccataccgagattgacaaagaccttgcgaccaagatgatctgaccaactgccgaggataaagtaagccagcaagcgcccgataccgattccagaaatcacgtaggaaaccgtcgctaacggggtctgccagtgttgacctagtgcttgcatgttttgcgttaaaataattaagccaatgccgtgaacaaagtagtttaagtaaagactgattgataattggtgctgacgcatgaacaacaactccttaatggaaataaaaaaagccggctagattgtgtaaatctagccggctcatcaaaaattaatctgaattgatgatattattccagctagactcacggtgtctagctggccaagatgaattgacttcgcttagacacgaacgtaggtgccgtccgtatctaaggttccaacacgggcgctacctaaaataagcaaagccataataataagttgcgttgaatgctaacgtcgtcatattcatctatcctttccgtttgattgattatttatattaaaacattctcattttaattcgtcaaccctaatttcattttaattttataatcaatacgccatcttcacttgcaaaggtggcgtcaggcatccctcgacactgttcaccagtgactgtaaaaaccatatcaacgacgagttgctcgactttatcggcggccgccatcagcactcttaaaacgacggttgaatacctaactcgccatcgatactcactgagcctaagagccagacaatgtctttctcttaggttaaacaaaaaatagtcgctgccaatccgtttggattcgcaacgactatttttttcagcgcttaatcttgacgcttcaagttattaattaattcatcgatccggctaccgtattgaaccgagttatcgcgttcaaaagttaattccggggttttatagatgctaagccgtgaacctaattcactacgaattaagcccgtcgccttagtcaatccagccgccgtcttttcaccatcggatgccttatctgacaaaatactgtagtagatggtcgcttgttgaaggtcgccagttaccgtcacaccggtaatggttacacccgcaacccgtggatcacgaacgcgttttaacaaaatatcgttaacttcgcgttcgatttcctgttccaaacgaccaactcgataatgttgtgccatctgctaatcccccttttaaaggttattcaactgggacttccttcatcacgtacgcttcaatgacatcgttaactttaatatcattgtaatcttcgattcgaagaccaagttcgaagccttgtttaacttccttaacgtcgtccttgaaacgccgtaagctagctagcttgccgtcataaataacgacaccgtcacgaatgacccgaacaccagaatcacggtggatgacaccatcagtgaccatcccaccaccaatcgtaccgaccttagaaaccttgtagatttcacggatttcggcttgaccagtaatttcttctttataagttggctcgagcatccctttcatcgcgctttcgatttcatcgattgcgttgtagatgacttgatgcaaacgaatatcaacatcgtcagtatcagcttgggctttggcttgcggagttggccgcacgttgaacccgataataatcgcgttacttgcttccgctaaggccacgtcactttcgttgattgccccaaccgctgtatggataatattgacccgcacaccttcaacatcgattttacgtaaactaccagctaaagcctcaacggaaccttgaacatcagccttaatgatgacgtcaacttccttaagctcaccttgtttcattgaatcaaacaagttatccaaggtaacgtgagcagtttgcttccgttcttccatcaaggcttgttttgcacgttgttcaccagcatcacgggcagtcttttcatcatcaaagaccacgaaacggtcaccggcgtccggcacatcgttcaagccagtaatttcaattggtgtcgatggtacggcttctttgatccgcttcccatggtcgttggtcatcgtccggaccttaccataagtattcccaacaacgattggatcaccaacgtgcatggtcccttgttgaacaagtaacgtggcggtagaacctttcccacggtcaagactagcttccaagacagatcccgcagcattctgcttagggtttgccgttaattcaagcacttctgattgaagtaagatcatatccaacaattcatctaggttcttaccgaacttcgctgaaatctgaacaaagatcgtatcgccaccccaatcttcaggaatcaatccatattcagtcaactgttccatcacgtggttcgggttggcacctggcttatcaatcttgttaacggcaacgatgattggtactttggcagctttcgcatggttgatggcttcaattgtttgtggcatgaccccatcatcagcagcaacgaccaacacggtgatgtcggtgatgtcagcaccacgcgcccgcatttcggtgaaggccgcgtgtcctggcgtatccaggaacgtgatagtcttgccatcgtgcttaacttgataagccccgattgcctgggtaatcccaccggcttcgcccgctgtcacgtgcgtatgccgcaattgatccaatagggtcgtcttcccatggtcaacgtgtcccatgaccgtaacaaccggtgcccggggtgccaaattatcggtgttgttgacttcatcatcaaagaacttgtccaaatcagtcacatcgacttgaaccttttcttgcgcgtcaatgccgtaatcagttgctaagatttcaatcgtatctttatctaaggactggttttggttaacggcaacgcctaacatgaacaacttcttgataatttcagcaggttcacggtgcagtaacttacccaaatcctgagcattcatgccgaccgtgtaaaccagtgtttctggcaacggcttgtctttacgaactggtgccggcttgttattgacctggcgaatccgttgattcttattattacggctcttattgttccggttgttgcgccgacggttattgttgttaccaccacgataacgaccaccgccattgccaccaccgttattgttactattcaaactgcccccgaagcggccactaccgttacgggaactgttattagtgccgttgctccggctattgttactactgttactgttcgtcgtattccggttgttattccggttttgaccaccgttgttggtgcggttgttactcgtatttgagcggttgttgttattcgaccggttgttgttactattgttagaccggttcgaattgctcccactattattgcgagtattgttgttccgtgaagcattggtcgaacgattcccgttactattgttagtccggttaccgccgttattgcttcgattaccgttactattacgactttgactattattttggttattattacgattattattcaaagaatcaccactctgttgatgacgcgagttggattgctgctgattagcagttcgtgtcacattgtttgctacggtttgcgtagcccgactagttttagctggagccggttgagatttaggatgggtaactgcagtcgcgccttgtaactgacgcgcctcactgtcaccgagtgtcgacatatgatttttgacggagaatcccaactgctgagcttgcgcgatcagctgtttacttgggacgttgagctccttcgctaactcataaattcgctttttccccatatcttcaccctcctttactgtgtcatgatcgccaccattttcttggcaaatccggcatcggtaattgcataaaccgtgcgcttattaccagtagccgtgtttagttctgctttagtaaaggtatcgatcactggaacatcataagattgggccttatcatgaaaccttttggcagtcgtgggaccggcatcgctggcaataaagaccagtttagccgtctgattacgaattgcggccagggctagcccttcgcctgcaatctgcttgctggcacgccgtgaaaggcccagtaggtttaaacaagcttggttaggcgtcatttccgaagagttcctttcgggcttgttgatgatcaacataggccactaactcatcgtaaaagtccgcaccgactttgataccaaacgccttgtcaaaagtcttctcttgcttggcgcgttgtgcgacctgtacgtctaacgcgatgtatgcgccccgtcccggcttcttaccagtcggatccacggacacttcatcctgcttattcttaacgacccggactaagtcttttttgggatgcatttcacccgtcacaatgtcctttcgtaacggcacttttctttttttcataatcccagacctcctttagttacttcactcacttagtgacgaacttattcagcgtcacttgctgattcatcagcagctgtttctgaggcaggcgtcgacacggtggcgtcggacgttgctggttcctcatcttcactggcatcggactgcactgctgcttctgatggtgcttcagtcatttccgtcgaagccgtttcagcagctgcaacatcatcagggtttgcatccattatatcagaagcttcagtttccgatttaatatcgatcttgaacccagtcaatttagcagctaaacgcgcattttggccacgcttaccgattgccagcgacaattgataatcgggaacgaccacggtacaaccccgctcgttttctggatcaaagataacatccaaaacttccgctgggttcaatgcgttcgcgataaatacggcctgatcatccgtccattccacgatatccatattttcaccgtggagttcgttgacgatcgtctgcacccgctgtcccttaggccccacgcaggtaccgactgggtcgacgttcgggttattagaacgaacggcgactttcgcccgatccccggcttcgcgagcaatcgagacgatttcaacgataccatcgaagatttctgggacttcttgttcaaacaaacgttttaacaaatctggtgcggtccgcgaaacgaagacttggggtcccttggttgcattttcaacttttgagacgtaaaccttaattttgtcatgaattcgataaacttcaccaggtaactgatcagaacgacccatgaccgcctcgactttacccaaactaacgtagacaaaccggttatcttggcgttcgacttccccagtaacgatttcattttcatactggctatattcatcatagatgatgccacgttccgcttcacgaacgcgttgcatgataacctgcttagcggtctgggctgcgattcgaccaaagttcttcggtgtcacttcaaaccgaatatcatcgccaatttcataggcccggttgatggctaatgcatcttgtaagctcacttctagacgtgaatcaaagacatcttcgaccacttctttaacggcgtaaacatgaatattacccttaatttggtcaaagtcaacttcaacgttttgtgcctgaccataattacgtttgtaggctgaaacgagtgctgcttccaaggcttcgatgacaacttcttttttaatgcccttttctgattcgagggtgtctaaggcccctaataattccttgctcatgtgtagactcctttacttatttagaactttaccgctaagcgggcttgtgaaatctgttctcggttgatcgtcaccgttttgtgacgtgtcttatccaagtaatcgatggtcaaggtggtcggcgtcaccgccgtcagatcaccttcaaaaatcttcttaccatccaacttctggtataagccaacgtgcacgtacttaccgatggcattttgaaaatctgcttccttcttcagtgggcgttctgcacctggtgaagaaacctccaaaaagtaggcttgaggaatcggatcaggatccatcgtatcaagtttttcactaagttcatcactaaccattgcacattcttcaatattaatgccgcccggtttgtcaatgtataatcgcaaataccagctctgaccctcgcggacaaattcaagatccacgagttcaaactgatgagcactgacaatggctgcggccactggctgaatggtttcaacaacattactactcaaggctgcgcctcctattcagattagtccaataaaaagagtgagcatcgctgctcactcgttaacgagttttaaattacaacccatatattagcacaattatgttcaaaccgcaagtttacgccatttatagcattaaaccgatgcgtttcaagtgacgacaaatttttgctctcaaggtctgacaatcgccggtatatcaacatagcgcgcccaagatgagtaaaatcaagatgattgccgtagaacacggctatcactgcaaaaattcatcaaactttaacaattatcgtacttcttaaaacaaagagagttggttttcgtccggtaagtcactcaacacaccgttttcggtcataaattcaatcaaactcttcgacacttttcctcgcttggataagtcttccttcgacaagaatggcttatccgcccgggcagcaacgatctgtttggcaacgttcagtcctaaccccggaactgctcggaacggcgcaatcagcgtgtcaccatcgatcagccagtccgaagcatcggacttgtcaagatcgaccatagagaatttaaagccccgctccaacatctcgttggccaactctaaaacagtcagcaagtttttctctttggcgctagcgtccatccctttgtcggtgattgccttcatggacgctttgacagcgtctttaccatgggccatcgcaaccaggtcaaaatcatcagcccgcactgagaagtaggccgtgtagtagatcaacgggaagtatactttaaagtaagccacccgcaacgccattaagatataggccgccgcatgggcccgcgggaacatatacttgatctttagacaagactcaatgtaccagtcgggaacgttggcatccttcattgcttgttgccattcatccggaatcccccggcccttccgcacgtgttccataatctgaaaggacatgtcagattccatgccgtagtgaatcaagtcggtcatgatgttatcacgacaaccaataacttccgccaaggtaacggtcccatccttgatcagctcttccgcatttcctaaccacacgtcagtcccgtgtgaaagccctgaaatctggagtaattcgttaaacgtggacgggtgagtctcttcgagcatgccgcggacaaaccgcgtcccaaattcgggaattccgagcgtccccgttttcgagaaaatctggtcttcagtgacccctaaaacttccgggctggagaaaattttcatgacgtgcggatcaactggtggaatactctcaggttggacacccgacaaatcttgtaacatccggatcatcgtcggatcatcatgtcccagaatatcaattttcaaaatattatcatgaatcgaatggaaatcaaagtgggtcgtttgccaggccgcactctgatcatcagctggatactggacgggcgtaaaatcataaatatccatgtaatccggcacaacgataataccggccggatgttgcccagtcgttcgtttgacccccgtcgttcccttcgctaatcggtcaacctccgccgaacgaagcgtctgattggtgtcacgttcatacgccttgacatagccataaccagtcttatcagcgaccgttccaatcgtcccagcccggtacacatttttctcgccgaacaagactttggtgtaattatgggcaatcggttggtagtccccagagaagttcaaatcgatatcaggcactttgttcccataaaatcctaagaacgtttcaaaggggatgttttgcccatcacgcaccatgtcagtcccacattcagggcaatccttaggtggtagatcgtagcccgacccatactcgttattcgtataaaagtgcgagtactgacagtttggacaccgataatgcggcggcatcgggttcacttcagtaatcccagacagtgtcgctacgatactcgaaccgactgacccccgagacccaaccaagtaaccatctttattactcttaaacactaggcgttgggcaattaagtaaatgaccgagaacccgttaccgatgatactcttgagttctttatccactcgtttttggacgatctcgggcaacggatcaccataccacgcatgggcacggtccatcgtcagtttttcgatttccgcttcggcacccttcatccgtggcgtatacaacttatccttgaccggtcgcacgatttcaaattggtcagcgattgctcgcggcgtatcaacgacaacctcgtgtgccgtctccgcacctaagaaatcaaagtctttgagcatctcatccgttgagcgaaaatgcacgtctggccgttcagtccggtttaacgggttcccgggctgtgaatgaatcaaaatcttccgataaatcttatcctcaggattcagataatgcacatcccccgtagcagcaaccgggatattcatctcatggcctagttcgaccatgttgctgataatttcttccaaatgatccgtatcggcaatcaagccactctcgatcaacgccgaatacgccggttttggttgtacttccaggaaatcatagtagccggccttttgtcgggcctcttcctttcccttttgcatcattgcggtaaagacttcgccactagaacaagccgaaccgaccagaatcccatctcgatacttgtttaaaatactgcgcggcacgcggggcacacggtaatagtactcaacattcgacaaggaaataattcggaagagatttttcaaccccgcttgggtttgcgcatacaatgtcgcgtgaaagggccgggcatgacggtaagccgcattttcattcatatgatcatttagctgatcgtggaattgaacatgataacggtcctccgcatctttcaaaaacaggtggttcaaatggccggtcgtctcagcatcatagatggcgcggtgatggtgctccaaattaacgttgaatttcttggccagcgtgtttaagcggtacccgcgtaaattcggatacaaccaccgtgccagcgtcaacgtatcaataattggatttgtaatcggccccatatgatgccgggcataccccgtattcataaagccgatatcaaaggtaacgttatggccgaccacgatggcatcaccataaaattcacggaaaagtttaaacacttcttcttccgatttagaaccccgcaccatgtcatcggtgatactcgtcaaattggtggtcgtatccgacaagtgaaagccagggtcaatgaattcctcgaactgatcaacgacgttccctttaaccatcttgaccgctgacaattcgatgacccggtcataaatggcggacaagcccgttgtttcagtatcaaaaataacataggtggactctttcaaatcaacgtgggcgtcattataagcaatcggcaccccgtcatcaaccatgttagcttcgaccccgtataaaattttgatgttatttttttcaccagccgcaaacgcttctgggaacgcctgcgcccctgaatgatccgtaatcgcaatcgccggatggccccatttagcggcttgcttgacgtaatcactgacactattggttgcatccatttgactcatattagagtgcaggtgcaattcaacccgcttctcatctgccggcgccgtgtcttgtcggctagcatgcgacgtttcgttaatgtcatacgcattgatcgttaaatcgcgcataaagctgtcttcttgcacggaaccacgcacacgcacccacattccaggcctcaatgccgcgaattgggcctcgtcatccgcattacgtgaaaacttcttgacgaccatcgacgaactatagtcggtcacctttaaaatcaataactgccgctgagaacgcaacgttcgcacttccatatcgaagacatagccttccacaatgaccgaccgttcttcctcggtaatttgcaccatctgtttggccggctcttgcgggttgatctgcttgcctaattggacaggcccatcgattggtgcaggtgagtccgcctgcttttggcgtttctcattagcctttttgatcgccgcttccgctttttgggccaaagcttgatcagacttcgctttctgttcatggaattccttgatcttcgcctgtgacgcactctcgtcaatcatcgtgtgaacggagaacttcgggaagcccaagcgatgataggtgctctcaatcggtcctaatgcctggttagttagaaaattttgaataacttcattttcagccagtaaaataacccggccatcttcataggtcggcacgttactgttacacagtgattggaccaggggcgacttgatgccactgtgctgaacgatccattcccaatattcagctagttcgcgaccattgacctcggtatcgtcggtcacgatcgtaaaggtcacccgggcaatttctttaaaggcgatttggagtttgttttgaaaagtcataaattgtgaatacggtaaaacatgttggaaatgcaaatgaaattcccaaaccttggaagcttgatgaacggtcaacttatcgatcgctgcttctgtaaattcaggacccgttggcatttcaatttgttcgagtagtttctcgaacatttcttgttggtttaaactcaccagtggtcctccttttgttgattacaatcagttactaagacacccaccgtacttgttaatttgcgctgacgtgcgcatacacgaaccaagcttaaatgttagctaaaacacaaattaatttttcagggccacggtacatcgttagcactgatctgtcagtttgcttaaacgacaccgtgatgcctcggttattaacggcatctgaaataatcttcagtgaacatgcaaatcattcacttgaaacgttactattttatcacagtctgaccgttgagccacgtgattaatcggcaaacaaaaatcacccagtcaacggaatccaaccaggtgattattgttggcgactatcaatgggtagttgccatattttgattaacttagttttgcagcactttaatcgatatttttgagcagaacggccaaattattggcaatttcttcccgcttgacttccagggtctcaccagtctggcgaagcttgatctcgacgatcccttcgctggcctttttcccaatggtaattcgtgctggaatacccattaagtcggaatcagcaaacttcacgccaggacgttccttacgatcatcatataagacgttgtaaccggcagcttccaattgtgcttcaacttggtcggcaacctcaacttggtccgctttcttcgggttaaccggaatcacgtgcacatcaaatggtgcaattgcttttggccaaatcaacccattttcatcagcgcgttgttcagcaatggccgacaacaaccgtgaaacaccgattccatagcagcccatgattaccggaatattacggccattggcatctaagacttctgcgtgcaagtctttagaataacgggtgccaagtttgaaaatgtgcccaatttcaatccccttggtgaacttcaaaacgcccgcgccatctggtgataactcaccttcctgaacaaagcgaatatcgacgtaatcttccgcgtggaaatcgcgttcagggttgacgttcgtgaagtgatgaccgtcttcgttagcaccgaccgtgatgttgaccatgtccttcacatactggtcagcgacaattttaacgtcatcactaacgttaactgggccgagtgaaccgaagctagcccctaggtattgttgcgcctgttctggcgtggccatatctaagaaatccgcaccaaggtaattcttcagcttaacatcgttgacctcatgatcaccgcgaaccaatgccattactggttgatcgtcagcaataaacagaatactcttaaccagctggtcagcaccaacttttaagaactcagccaggtcgtcgatcgtacccactccgggagtgtcaatcttttccatatccttcaacgaagcatgggacttcttgggcacgtacaggctccgggccatttccaagttagccgcatagtcactcgcatccgaatacacaatcgtatcttcacccaccggtgcaatagccgaatattcgcgggagtccttaccacccatcgcgccaccatcaccgatgattgaacggaacttcaagccgacccgttcaaaaatgttctgataagcttgtgccatgtcctggaacgtgtcgtccaatgaggtctcatccgcatggaacgaataagcgtccttcatgataaactcacgcccacgcagtaacccataacgtggccgatcctcatcgcgatacttagcctgaatttgatacaaggtcaatggcaaccgtttatacgatttgatttcatcgcgaacaagtgacgtgaacgtttcttcatgagtcgggccaaggataaattcccgatcatggcggttcttcaatttaaatagttctggaccgtatgtctcataacgcccagttgctttccacaactcagctggaataactgctggtaccagcatttccgctgcatcaattttttccatttcttgccgaatgattttttcaatattcgtcaatacgcggtaagccaatggcaaataggcgtacattccggctgaaatttgtcggatatagcccgcccgtagcatcatttgatgactcaaggcttcggcatcattaggcacttccttgagtgttgggattaacaatttcgactgtttcatctacaaatcttctccttattgttccaaattaaatatcacttagaagaaatatcgctgaatatcattccaagttactagaatcattaataacatcaggaggccaaaaccaatcaaggtaatgacactttccgtttccacccgaagtggtttaccccgaatgccttcaacaatgtttaataatagtttaccaccatcaagtgctggaattggtaataaattaacaattccaaggttgatcgacaatacagcgagtaaatagatcaccgtacgcaccccggacttagcggcttgcgaggtcgtcgcaaaaatcgccaccggcccgcctaaatcgttcaaactaaaaccgtgcgtgaccatccgaccgagcacttgaaaaatctgcttggtgattccccatgaaccagtaaagccgtatgctaacttggctcccaggctcgtgtcggtcttggtcgcccattggaccccgatttgaccgattcggttaccagagaccgtcttagcagcgggggtcaccgcgatttttttagtctgaccagctcttttgatggtcagattcaaccgttgtttcggactatcttgaatcaacagcgaaatcgactgagcactcgtcatctttttaccgttaaccgccacgatttgatcacctttttggatgccggccgtacgggcaactgagtctgctgtcgtcgccgcaacgtgcgtcgttgtactcgtaacgccaccctgcataaaggccagaattgcaaacgtaatgatggccaagatgaagttattcatcgggccggcaaaattggtcagcatgcgttgccatagcttggccgattgaaattggacgtcgaccggcgcaatttgaacctcggtaccatcactttcgacgatcgtcgcgtcatggtcaacggcgtatcgtttgacttcactctcgtctccgttctcgtaaccctcgatccagagttctttttcgaggtcagtcgccgtcactgacagtggaataccattgaacaacgtcgtcttcttactagcattgattgaatgaacaattccatctgaaccaacttgtaaactaactggcgttccgggcttgagttcttcatcctcatcgtcagccacgccggccatgcgcacgtaaccaccgattggcagaaaccgcaacgtataagtcgtggcattacgacgaaacgcgaccgccttgggtcccatcccgacagaaaattcacgcactaggatcccagcctttttggcaaaatagaagtgcccaaattcatggacgatgaccaagattccgaaaacgataatgaacgtaataattgtaacgatcaattaagcgctcctttctcccgcgtttcgggtactcagcttaaaaaaggccgaataaatgtgcaatcggaaaaaccaataacatactatcaaaccgatctaagatgccaccatgtcccggcaaaatcttaccggaatccttaacaccatagtagcgtttcaacgcggattccactaaatcaccaaactgaccgacaactgataagactaaggtaatcaataccatactgatgacgctcgcataaccgacgtgaaaaccgattgcaaaggcactggccacgatcacaccaatcacgctaccgccaatgcagccttcccacgtcttattgggactgatcggtgtgactttatgccgacccagtttgcgaccgaccatgtaagccccactatctgtcaaccagacaatgaacatcaggaagagtaacatgtacacgctgacgccccgcgcagccgtgaaatagttgaagcccatcccaatgtataacacgcctaacgtcaacatcccggcatcatcaaatgaaaaacgatttcgcgaccacacggtgtgcaacagtaataagataattaagaagtaaaccacgtactccttatttaattggtccggtaagccattgaaccagttgtttggtgcaatttgaatcatgactgcgagcatgcttacgattgcttcaaatgaaatcaatagttttttgcgcatcacgagtaactcgctcatcgcaacagcccctagcaacatggccacaatatctaaggttaccccgcccacaaaaatgactgggataaataaaattaacgcaacgacagccgtaatgactcgttgtctcataccaaaaactcccttttatttatgatccgacaacccgccaaagcgccgatcacgactctggaaatccgcaatacaggcttggagggtcgccgccgtgaaatctggccactttacatcagtaaagaccagctcactgtaggcaatctgccacattaagaaatttgaaatgcgttcttcgccactcgtgcgaatcagcaaatctggatcgttgtatggtgcaagtggtgccgtcatcagggcggcgtcgatggttgcatcatcgatatcactaaccgccaattgaccatcttggacttgctgggcaatcttttgcaccccggtcacaatttcggcccgtgaaccatagttgagggcaaagttcagcaccatgccatcacaatctttggtatctgcaatcgcattttgaactgctttttgcgttgcttctggtaagcgatcaacataacccatgacctgcacccgaacattgttttttatcaagtccggtacgaaagtatcaaagaaactcactggcagctgcatgagataattaacctcatcagttggccgcttccaattttcggttgaaaacgcgtaaagcgtcaggactttaacgcccaaatcacttgcggcaatcgtaatcttttcgaccgtgttcataccttccttatggccagcaacccgcggtaaatgccgtgctttggcccaacgcccattgccatccataataatggcgacatgggctggaatacgttcaggatccaattgcacgtcggtgttatctgcaggatcattcttattaaaaaaagcgaacaaggcgcacctccataaaaatagcttaactatgcactattttaccaaaaaaagcactaattaactattcgtcaacaaaaaaaggcttgaatttctccaagccttaataaattggtcggtcattaaccttccaaaatttctttttctttgtccgcaacgatcgcgtcgacgtccttacccgcttgatccgttaacttttgggcttggtcttctaactgatgtaactggtcgtcagtgaattgaccatctttatgacccttcttcaaggattccattgcatcccgacgcacgtttcgaacggcgaccttggcacgttcaccttccgccttaacgtccttggcgagttctttacgccgttcttccgttaattgcggaataactaaccgaatcgcagaaccgtcgttagctgggctaacaccgaggtctgacgctaaaatagccttttcgatttctttaagggcgctcttatcaaatggggttaccattaagacccgtggttcgggtaccgtaattgccgccatctgattaagtggtgtttgcgcaccgtaataatctgcagaaatccgattcaatagtgatgcgttagcccgaccagcccgaatattaccaagctcgcgttgtaaagcggcttccgccttcttcattcgttcctgtgcttcttttaaaattggttctgtaattgccatactatttccccctgactgttgtcccgatgtgttcaccggcgacgactttgcgaatgtttccaggttcattcaagttaaagaccacgacgggaatgtcattatccatcgataaggaacttgcggtcgtatccatcacttgtaaccctttgttgataatgtcgagatgggtaagcgtatcaaatttaactgcactcgcatccttgttaggatcagccgagtaaacaccatcgacgccatttttggccatcaaaatcgcatccgcgttaatttcagcggcccgtaatgcggcggtcgtatccgttgagaagtatggactcccggtaccaccggcaaaaataacgatccggcgtttttcaagatgccgcatggccttccgtcgaatgtatggttccgcgatttgccgcatttcaatggatgtttggacccgggtcggcacaccaattgattcgagattatcttggagcgctaaggcattcataatcgtggctaacatgccaatataatcagcttgggctcgttccatacccatttgggccccagcttcgccacgccacatattgccaccgccgacgacgattgcaatttgtacgcccatgtcatagacgtccttaagttcctctgccaccgttttaatgacgggcgggttgattccaaagcccttttcaccagctaaggcttctccactcagttttaggattacacgcttatatttaacttccgacatcgttttgtcctcctcgaaattatctgtctatcattttaccatatatttcaataagcgtttggtatcagccgtaatccggcacaaaaattaaccgaattctctttttaaagcggcttcaacccgttactttacaaaaagggactacgccgaaaattgctttccgtcgtaatccccaattagctaatcctttagtcagtaattagtctttgatttggttcataacttcatcgatgaagttatcagccttcttttcgattccttcgccaacttcaaagcgaatgaatgagctaaccttgccaccctttgattcaacaaagtgcgcaacagtttgatcagaatccttaacgaattcttggtcatccaagctgatttctgaaagccacttgtttaaacggccttcaaccatcttttcaacgatcttttcaggtttaccttcattcaaggcttccttaacaagcacgtctttttcatgagctaaccggtcagcaggaacctgttcacggttaacatattcaggattgatcgcagcgacgtgcatggcaacgtccttagcagtagcactgtcagcaccgtctaagacaactaaggctgcaatttggccaccgttgtggatgtatgaaccaaaactttggtcagcacccttttcaacaacttggaaacgacgaagactgatcttttcaccagttacttgagtcgtttcgatgacgtcatctttgaccgtcccgttagccgtcttcaaagctaaggcgtcgtcaacggaagcaggttcttcttcagcaatcttgtcggcaacttcagttaccaagtttttgaacttgtcagttgaagcaactgaatcagtttcacagttgatttcaacaatggcagctttgttgtccttgattgcaacggcagcaatcccttcggcagcaacccggccactcttcttttcggccttagcaacccctttttcacgtagaacgtcaacggctttttccatgtcgccttcagtttcaactaacgcctttttagcgtccatcataccaacaccggttttatcacgaagttctttaacttgtgctgcagaaatctttgccatagtttactctcctttgagtatcttgattttagataaaaagctgcccgcaaaatcaggccgtaatggtccgcgatttttaggcagcctaattatttcaattaattatttgtcagacttggcgtcgttgtcgccttcaacagcttcaacgatgtcttccaatgagtcaacggacttcttagcgtccttgttgtccttgaaagagtcttcagtaacatcttcgtcttcaccttgacgaccttcaatgacagcatcggccatcttagaagtgattaaacgaacggcacggattgcgtcatcgtttgaaggaatgataacgtcgatgtcatctggatcagtgttcgtatcaaccatcgcaacgatcggaatgttcaacttttgagcttccttaacggcgatttgttccttacgaggatcaacgatgaagattacatctggaatccgaggcatgtcttcgataccgcccaagaacttttcaagcttggcacgttgtttcattaataatgaaacttccttcttaggtaaacgttcgaaagtaccgtcagcttccatcttcttcaagtctttaagacgcttaatccgtgtttggatggtgttccagttagtcaaagtcccacctaaccaacgatggttaacgtagtattgacctgcacgggttgcttcttcttcgattgaatcttgggcttgtttcttagtcccaacaaacaaaataacaccgtcatcagctgcagcgtccttaacgaagttgtaagctgagtcgatcatcttgaccgtcttttgtaagtcaatgatgtagatgccgttccgttccgtaaagatgtatggtttcatctttgggttccaacgacgagtttggtgaccgaaatggacaccggcttcaagcaattgtttcatagaaataacagccataataaatgtgcctccaaaaatttgttttattcctccccaccgttcaactaatcatggcactctcccgagcaccgccatgattatcgcagtaggtgtgaattggttttaacaccgaaaattagtataccgaaaattactagtgcttgcaagcaatttcatcaagaatttgtgaattcctgaaagtgtgttaaaatacaatctcgcatagggggctcacttaataatgataaaagccatcatttttgaccttgacgatacgttgtatgatcaaaaatcaccgttcactgctgccttaactaaaacttttaaccaggctttgagcagcactgaattggcacaaatttttaaccggttccatgattttaatgaccgtacctttaaccaggtcactgatacaactatgacgctggaagcgtggcaaaccgcccgtattcgacacgcgttagcacccagcaaagtccacatcagcactgattgggctatccaatttgaaatggcctatcagcaggaactaaatcagatttgccttttcgatgggctgagtgcgacgctgaccaagctcagtcacgcatttaaaattggtatcattaccaacggaccagcgccgattcagcatcaaaagttacatcaattacaaattgaacatttcgtgcatccggataacatctttatctcagaagaattgggtattgctaaacccgacccatcgatcttcacgacgtgggcccatcaggttggcatcaaggccaacgaagccgtttacgttggtgacaatgcagcactcgacatgaccagtgccaaacacgccggctggcaaactttttggtttaatcaccggcgcaatgaccaggtgacaccgagcgtgatccctgatcaaatcatccagagtccagcggagttaaatgagttgttgttagcacttcttcaggcggccagtgcttcataatcccgactaatccaacatttaatcggaaaatgtgcgggcctcatgatggtccccgtcacctatagacctgaccttgacaggcacgtaccaggcagccctggacagcgtaacactgcctcagattttaactaaacagcttatttttgaggacctcaatcgtgcagccagcgtgattgaggtcctcttataatatgcgggtacttcgctgcacgttttcaatacctacattacaatgctgcttagtcgcccagaatcgtctctaacaaaccgccttaaattcagccacaaaaaaatgacgccactcagatgagtgacgccactttttagtaatcgagattagtcaaacttaacttgcgtatcagctttaccagtttcgatgaattgtttgttactgttcattgaaacgtgcaccatgttgtgaacggcagtttcagtgtagaaagccgtatgtggtgtaatcaaaacattgtcgcggttgaacaagttcatgaagaccttgtcatcaatcgtttgaccttcaaggtctttgttgaagatcttagtttcgtattcatacgtatcaagagcggcaccggcaactttgccactgtctaaggctttgatcaagtcttctgaatcgatgagtgtcccacgagcaaagttcaagatgtaggcgccatctttcatcttgctgaaggcatccgcattcaacatgtggtagttatccttcaatgcaggaacgtgtaacgtgataacatcagcttgggcgtataattcgtccaaggtgtcaacgtacatgccttccttttcaagttcagcattccggtaaacatcgtaaccgataaccttagcgccgaagcctttgaaaatatcgatggcagcacggccaatccgaccagtaccgataacaccaacagtcatggtgtttaattccttggcaatatctggtgcccaacggaagtcttgcttagctaacttcttgttgaacaatggggtttgacgtaataattgcatcaattgcgttactgataattcagcaatcgcatttggtgagtatgcaggtacgttagaaatgtttaagccacgtgctttaacagtaggaacgtccaagttatcaacaccaacgttacgaagagagatgttcttaaccccttcgtcggctaacttgttcaatacttcagcagtatagtccttttgttggtatacatcggcaccgtcgaagcctttagctaagtcaacgttgtcttcagtaagtaattctggaactaatttaacttcaacatctgggttttctttcatccaagtatcgaagaatggacgttcgtcatcacgtacagcatatgcaataattttcattacaaaaattcctcctatatattgatacagtaaatattataacagtaaatgcgagaaatagaatcataaattgtgaaaacttcgctaaattttcacatcgtgagctgacaagtattttagcttggcagctcgcgattggtgtttgaaggcatattcagcctttaacgcacttgatttgtcagtgaaagtttcatgataaattaattgcaaaggccgccgtgatctgacccgcgtatatttagcccctttgcccgcattgtgcgttgctaatcgtcgctgcaagttatccgtaaaaccaccatacaacgtttgatcagcacataatagtacataaaaataatattttttgattgccgtcgtggacgcagccggcttacttgtgcttgccatagagtaacgtgtgcacctcttccccgtattcaccatcatcacgataaacgacaagcggcggcatgattcgaacaccgttgcgtttcccgtccttgatcatttcgattagaaccatgttcgcttcccgttgtgctttcgggtggacgaaccgcatccgtttgggtgccaaccgattggccgccatcgcactgaataaatcatccaaacgttcaggacggtgcacaaaataggctttaccattcattttcaacaaatcactagttaccgctagaatctgatctaaattagcggacaattcatggcgggcaatcgccaaatgaggatttggatttttgacactctgcggttgatctttaaaatacggcgggttacacaagacggtatccaccgaatccttcggtaattggtgcgtaattgccaataagtcttcgttcagaactgtcatttgctgggttaaatcgttcaaaataacactgcgttgggccatctcagccaaccggggctggatttcgaccgccgtaatatgaccttgagttttggcactggcgaatagacctactgcgccattgccagcacagagatccacaatctggctcttagcacccttcgcaacctgggcaaagtcacccaataaaaccgcgtccagtgagaacgcaaagacttgggaactttgaatgatttgaatatcttgactatataattgatcaatacgctcatcggcgtgtaacgtgacgtctgccatattcggccacctctccattcaattcgtcgcacagctatcatacaattaacttgcagaatttgccaaatttcgtcatactgtgagcagttattaaacgaaaggaagatcgtgatgttttattcatttatgcgcggactagtccggctaatcatcaccattattaacggtcggccgcgctatcaaggccgggaaaacctacctgagggggcctatatcctagttgggccacaccgcacgtggtttgacccgttgtactatgcattagctggcagcccaatgaaatttagctttatggctaaggaagaactatttaagaatcccgtcttgcggttcattctcgtccatgcgaacgcttttcctgtcaatcggcaacatccaggaccttcagcaatcaagacccccgtcaaatttttgcgcagcggtaagctttcactaatcatgtttccatcgggaacgcgccactcacaagaacttaaaggcggcgcaaccgtcatcgcaaaaatggccggtgttccactagtcccaaccgtttaccaaggtccattgaccttcaaacaactttttagtcgtcagcgggtcaccgtccgttttggtaaaccgattgatattgatcgtaagttgaaactagatgatgctggtcaaaaacaaattgaaactaaaatgttgcacgcttttgacgacttggatcgtcaaatcgacccaacgttcaaatacgttgatcctgctacaacccgtcagaaacattaagttcgataataaaaaagtgtcggcgatcgcaatttaaagcgagccgacacttttttactacttgttatcgtttttagatgcagctttcattgaattcaacatctgatgtaacttcttttcggatgggcgttgacccatttgcatcatcatgctccgaagcatttcttcactaattggtggattttgcttcaagtaattttgcatatagtgccgggcaccgaagaaaccaccagttaacccaactaatacgccgataacgacgattaaaatccaaattccagtagacacagtcattcccctcccttattacagtcttcattaaactagtctacacaaattaataataaaagaaaaggaaaatttgtcagttgacaaattttcctgaaatcggttaatcatctcgaagaccgcgatcacgttgcacttgacggaccttttctggcgtaacctctttaccatctttatcataaacctgaagcatttcaacttgttgccgaaaaccggcgcgaaattccttcaagtatttttgccgcaactcttgacgttcggcttcttcaagctcggtgagcccctcggcttttgccttatgagctaactcattgatccgagcaagcaattcttttgaaatcaaatcagcagcccctttcactcttgaaatatacacgaaattagaccctaaatcaattaatagtgtttgtcaaccgaacatttgtttgaaagctatgaaacgctatgctacaattgttttaaccaataatgaaaataaaaaatgaggtgccaagatgagtaaaacatcggaaagcaaacaaatggccgttcttcgctttatttatgaacgtgtcaatgaaaaaggatacccgccaaccgttcgtgagattggtgaagccgttgacttatcttcgacttcgaccgtccacggccacatttcacggctggagaagaaaggctatattcaaaaagacccaactaagccccgtgccattgaggtgacaccagctggtttcgaagccctgggcgtcgaaactacgccccatcaaattccggtacttggaacggtaaccgccggccaaccaattcttgccgtacaggaagcgacggattattttccaattcctaaggaacttgaatcattcggtggcgaccttttcatgctcaccatccgtggcgaaagtatgatcaatatcggtatcatgaatggtgatcaagtcattgttcggcgtcaaagttccgctgacaatggtgatatcatcattgccatgaccgacgagaatgaagccacttgcaagcgattcttcaaggaggccgatcactatcggctacaacctgaaaacgacacgatggcaccgattatcttgaacaacgtctctgtgttaggcaaagttgttggcctatatcgtgacatgttgtttcagtaatatgaacactcacaagatgacaattcgatttgtcatcttttttattggccactcttttggaccggattgccggcactatctgcagatctcgtcacagatacttacatccttcccgctgggccaaggccgaaagcgcgtggtttgcgacaaacgtgcgcacccattccggattcaccttgctgtaatcccgtaacgcccagccaatcgctttctggatgaagaaatcttcatccccctgattcgctagtatcgccgtttgcaaatattgggagtccgttcgctctttccagcctaattgaagcgtgattcccacccggcgcacccatttatctgtagcccgcaagtaaaccggccccacttattgcaaacaatcatgtgtcaagatgtacgttgcaagcaccttgcgccaggcatcaacactatcccaccatggcgttactgtgatttggcgatagcaccactgataatgagctggtgtcatgtggcggacgttagcttgggcgagatcaattgccacgtattgatattcccgataaggttgttggtaataaaatgcaagccaagcttgtaattcctgaggcgtgagttggtgactctgtagccgtaacgggtgcaatagtgctcgccgttcaccagcctttacacctaagaagtgaaactgatcacgcatgtacttagccatcggtgcctgattctctggatgtatcggtagaaaaagtggtggtgttaaattagccattagtcgggcctcttttcaaaatatttcaaatctgtgacgaacagccaatagttcaatggtataatgattatactattttaaacattgggagttggttacatgttgttcctagccattatgggcttgattgtttttctattagcattattttccgtgatttacgcacgtcaaaccggtggtggttggaaatttctaacactagttacggtcctaagcgccctagtcaccatttacgcggtcgttaaattgccttactggccatataaccagtcgcagcaatcgacgcgcaaagcatcgtccagcacgagtaccagtgctagtaccagtaagtccaaatcaacgagcttgagttcctcacaagttgtttttaacgaagctagcaccaagcgcgcggccgcaaccactaagttgaatgaagaaaacatccttaaacaattgcaatccaattatcaatcaattggcaccgttgcattcaccaagtcaacgaaaacgtatacgattacgccaaccaataaaaagtacgttaaatctttgaagacgattaaatcatatccatctcaaaatcaaaaagcaatcaccacgattacctcaaatttcaaatctttgtcaaaatcgctccagaagaatcttgccgctggttacacgattcaattgctacagccagataccactgacaagaccctgttgagtgtcaaagatggccaaatcatcaccaacaacttcaaataacaaaagccacttgcctagcgaatttgctagtaacaagtgacttttttcttaaccttgtcgatccaaatactggcgttgttcgtccttttgaccggtcaatacgaatcggtggggatcatcagcatagctgaccgactgatcatcagcccgccattgcagttgatgaccaaataaggcctcatattccgccacgctaacgcgacgccgacgagccagtcgttgtggcaagctctgatctaagcccgcctgatagtccggctgaatgaccccggtataaaattcgccctcagcacccgagccataactgaataatccgagttggttccctggttgcaactgagagtcagtcagtaactgcgataacaagctcagatagagtgaaccagtatacaagttaccaacttgccgattcagctgacgcgcatgttcgaagtgcgccaaccactgggcttgctgattggcacccaccaatggcaacacgcttcgaagtgccttaagtcccatctttgtatatggcaaatgaaaaactaaagccgtcagtgcttccggactagtttgagtcgtttgcaggtaattcttaaacacatcttgaaaataatcaatatagatattagacgaatatttgccgtcaactagggcttctgtatgatacaacggccgccaaaagtccatcacatcttcgctcaatagactcgactcggtacccagtgctaatactttaggatccgcactaattaacatggcaaccgccccgccaccttgagtcggctcgcccggtgtgttcaaaccgtagcgtgccacgtcgctaccaatgactagcgccttcttatctggatgaacacgcacgtgatcttgggccaattgaacaccagccgttgccgcataacaagcctctttcatttcaatcgtccgaacacgtcggtctaagccgagcagcttagcaacataaatcgcactcgctttagaattgtcgatccccgattcggtcccaacgactaataaatcaatagccgcaatgtcggcggctgtcagcatcggtgccgccgcattagccgctaatgtcacggcatcttgacttggcggaatcaccgccattttggactggccaatgccaatcagatacttatcaggttctgcctggcgagccgtcgccagttccgccatatctacgtataaatgtgaggttgcaaagtgcaacttgtcaattccaactttcacgtcttttcctccaatttgttaatgacaataagggattaatgggcacgtccgagtggccccaagtaatgaaaatcaggatcacgtccgatccgataacagctgaaggcccgactaatttcattatgaaaagtcacaacaatcgccggggtcgcccacgtagacgctgcccagaaaacagtgtcgtcgaagtcccggttgtcattcgggtaacgatgataaccttgtacattatcccaaatggtgccgtgcgtattcaaccagtcttcagcgagtccggcttccacctgcatcatcacgtcctgattgtcgtcaatcagactgcttattttttgccaatcgagttgccaatcgtgcctgtggggattttgtccacgcgttccaagcggtgtatgtcccaatgcaatcggggtcaattctacaaaatccatcttgaccaccccgttcgttaaccatcttaagatttcttaactattatagcatttcacaactaaaatattgcccgcaattgcttgacctgggacgggttccataatttatgctgaggttgaatcaggtgattatgacaagtatcaagtaaggagcgcggtatccatgtggttttcacgtcgtcaacaacgaaatagtcttcaggcacccgtcgccggaactcatacggcgatgcccgcggcaacctcacctcagcaggtcggggtattagccgtgcaaccaaccagccaagtaatcaatgccccgctcgacggggatatcatcagcctgtcaccgtcaagtctcgtgatcaattcactcagcggacattatattgagttgcgtatcgacacgccatacttccaaaacacctgtgactggcaagtgcgcgtgggtgattccgtttccccactgacgatcttaggtacactttctggatcattagacggtgtcaccatcgctatctatcgacttaatcgtattcaggcaagtggttcgatcacactcgcaagtaactgacgctttgtcatcatcaacttgtcgctgttaatcgccacacacttccgtcacctgctgaaagcgtgagactgttaagcattgttcacacgccttgacaatctcatccaaacgctcaagcgtaacccgctaggaccttttttctgcagtttttgccagcgccattcctgtgcctgacagaaactgttttgttttgtaaaccgctccagccggtacggtgagcgagctgggtaacttggtgtttggttggcgcccttagaattgggggtacgcaagcacgtcattacaatttttgtgccttgatatttgattgctttatacctcaattcaagctatgatattcatactggtttaaatctttattgatcagtaagtgccttttatatagctggtgctccgttaatatcaagcaccctaattcaataggttactctaaaaaccataaaaaggtcggatacaattactatgaaaactatgagtctcgttgttccctgctataacgaggaaccaacgattgaaatattttataacaccgttgaaaaagtcctagcagataatccagaatcgttcaaggatatcactactgaatatgttttcgtcaatgatggctcatctgacgatactttgaacgtactacggactttaaacgccgaccatcctgacactgttcactacgtctccttttcgcgaaatttcggtaaggaagctggtttattagccggtttagaacacaccattggtgattacgtggccgtcatggacgttgatctacaagatccaccgactttattacctaaaatgttggcaatgcttgaaagcggtgattacgactgcatcggtacaatgcgggaaaatcgtgccggcgaaccaatgatcaggtcattcttgtcacgctcgttttactcggtcgtcaacaaaatctcaaaagtaaaaattattcccaacgcccgcgattaccggttaatgacacgtcaaatggttgatgccatcttggaattgcctgaatataaccgattttctaagggcatctttaactgggtcggtttccgaaccacttatttgaagttcgaaaatcaaccccgctccgctggcgaaacccactggtcgatttggcagctgttcaattattcaatggacgccatcgtcgacttttccgacgttcctctgaagattgcgaccttcaccggtggcttgctatcactgatttcaattatcagtatatttgttgttattattcgtaaaatattattcgataacagtgtcagtggttgggcctcaaccatcacgattttgctcttaatcggtggtattcagctgttctgtctgggaattatcggcaattacattggtaagatttatatcgaatcaaaacaccggccgcactatatcgtgcaggaaaagaagtaagatcaattttgggaacgatatgaccaactgagcacttctaacttgataaaattttatatttttaatctgctttcaattttattattgtatcgcagattttttattgttttaaatgtagaaaatagattgcccatcatgcgtacccgtcttagcttcacccgttttacttttcaataaactcatcactagcatattgctaataattattagatgtagaggccttccttggcatccttaattcgttaaccggcagcatcagatgttcgcaactgaaaagccaattgcttgactaaaaatcagccaaaaatttcacgagcttttacatgacatacaacttttaatgtctttctcgccgataggctaacatccgtgcagcaattttgtgtgaatctgttttagattctctctgttttatcccagtagtcttgttcaagaaatcacggtcaatgctaacttcaatgccaatctcatcaattggtccaatcaagacatcccaattaacagtcaaataatgttcgacgattgacgcctcctcatcgccatcatagatgtccgtcaattcaatttatttataaccatgatattgctgtagatgaatattcgtcttaaatttttctcaaaactcacacaaaacacattaattgccatgacttttattgaccaacatactgaaatcttttgaataaatatttattccagtggcaaattatgctatactaattaagtaacatattggagagttggcagagtggtaatgcaccggactcgaaatccggcgaaccggctaataccggcgcgcaggttcaaatcctgtactctccttaaattgtttatctgtaccagccatgagcgtcgccaatcgtagagttgacggcgtctttattttaatttaattgtttcaaaacgggtttaattgatataatggtgcacttttacgaataagtaccaaatttcgatgattgagtgcacttaaaagtgcaccaaaaaaattcacgtcgctgtaactctttgtgccccaagggattacagcgacgacaaaagcacacaagtgcctaggcgggtaatacataatcacaaaaaatccccacactcagctacaaaagtcggtgtgaggattttttgtgatttcaaggtcagatgaactaactctattcagttgaaagcttctttaaagctccaaatatttccggatttttcagaatttcactagttgccttcttaacatctgttttatctggtttttttgtttcagtcgttatctttaaaggctcagtcaactgtatatctacattaaacatatttgggaacctcttttcttatttaactctaaattcatttttgtttatcatactgttgtaacattctagaatagtctagacttgtatttttcaacagataatcatacagtccatctgtgtctagctcatcatttgcaattttctttgaaatctcatacatttcatcttgtttgaaatcaagattcatataattaagcttcatgaacaaagcagctactattaaaccggttcttttattcccattggaaaatatttgataatgtgccaatttccgccagtagactgtcgcttttcttaatagagtaggtatagtatcctgaccgtaatacactgagttctttgtagcttccactatattgtctaaaagtttctcatctcgaatcccataagaaccataaattccatattcctcaaaaattttctgtgcgtcactatttgcttgcatcactaactccacagttggaaaaactgcgagttcagtagcaacaaccagcacctttttcactactttatcgtccaaaacaattaacatagacgcatgaagatcatcaagacgtctaatttttgatgccagtctattcttatcaataattaaggatgaatgttttttataatagtcttgcatcaccagttgtcccaattcattgaattgatccacaccctcttacattagatacactaccagattataccttattccatcatatattacttttctttttttcatagcgtcattttatcacgttccattcaacaatcaaaagcttttactctccttattaaaatagtagagaccagccagtaaaaacaagaatcccaacaagcattgatttgtcgggattcttgttttttatataattcaaatcaaacaagtcaatatcaacatggtttgctacctactatactgtttggaaatggtatggatactactattgcaaaataggttttagacttgagctactcttgcctgctccaaaattttggcactcaatatcaacgctttcttgaaccacctagaggttttctatactattggtttagtaacatattctaaagctgcttctttaattgttgaatgccaattcaaattcattcacatcaatgccttattaaacatcggcacttgaaataatcataatgatcaacaacatcaatcaagtaataccattccccactaatccacaaaaaatatccgtcagcccttgccaacggatacccaattacttctgttcacgtgcggcttgaccaaaaacaaagaacgaaccaagaatacccacgcatgatagtaaaaataaaatgccatagcacagtacatcccccactgtcactaaagtcttcggaaaaccggcagttgagacccatagaaaaatcacgcttaaccaaaaccaaaatgagcgataaaaccgaaccggtcgacgtatccgcatgacgctcccccctaactcgttattccaatgaaataaccgattggaataacgcctattataggcagtgcgcagttaagtacaagcgctgaatactcaaatccaacgtttaagctacaattcgtaagcgattacgtttgttaagtgccaatccgattaatatgccccctcgcaaccttaaccacgacgagccagtttacgagcgataatcataaatcggtcttcaaacgtcgtgacgcgaccattaatggccagtaaggattgtaactgatgtaatttgggaagcatccgtgccacgtcaaaatgcggaaactcccatggaatcaccgtggcataatagacaattgcgccaacatccgtaaaactcagggccgcgtaggcttgctcagcccgcagaatttcaaatcccgcagcctgcatttgagccattaccgtcaacaactgattgtcaggatacgccggttcgtaatgctcgtcaaagaatcgtgacaacgcataattattggtcgcaccaacttgctgagtcacaaatcggccccccggctttaaaacttccgcaattcgcttcactggcattgcaccatgactattcgttacaatatcaaatgtcgaatttggtacggccgtcaactgttcggcggcatctggatataatgttatcccctttttaaccaccgtttgcttcaacaactcaatatttggttgccacccctcggtcaccgccgttagcgctggctgatggttaaaacgccccatcaattcaccaccgcccgtatcaatatccaaccaccgatcatcggcacttagatactcacgaacgagggcagcgtaatcccacggcaagtccgcagtctgccaccggcctgccagatgactaaagtcccagccgtgcatggattgctgcgcttcttcaaaccaacttctttctaaagctgtcatattttgcctccttcgtttcctgtaaaccagaccactcatcaaagtctccgctggcctatttcaatacgaattatgctatgattacaatatctttaaaaggaggttcagtcaatgacacaattactggtcacgaccactgaaaatattccggggcacccctatgaagttatcggtgaagtctttgggctaaccactcaatctaagaatctggtccgtaacattggggcgggcttaaagggcctagttggcggcgaaatcaaggattacaccaagatgctcgaagagtcgcgcgatgtcgcggtcaatcggttgcgcgataatgcaagtgccatgggtgcggatgccgttgtgatgatgcggttcgacaccggctccattagtcaggatatgcaatcggttgccgcatatggtaccgcagttcgttttatcaccgaagatttgaccactgacaatgcttaatctgattcgagactaacgaaaccgcctgccggtaatctgggcaagcggttttttagcatggtggcagctgtttgtataacacaattataattttcgtcaccggcgaatgaacagacaaccaccacaagctaacagtaatcccatggccgtcaaataagccgcttctgggctcacgatattatccaacaagaccaatccaacactgccgattggaatcgaaatcgtcgccaatgaatttatgatgccgcctaagctcccaacgatactttgatcggccactttcaataaactcgccatcaatttaggatttgcttgtcccatacaagatcccccaatcatcatgattgtaaccactacccaatagtttttccaaatcaacagattaataaataaccccgcaaacgccacgacggtagttaacatgacaccacgaaacgtccacctctgaaagcaacctgtatgtaacaaattccctgcaaccgatccaaatacgtcagcagtattcatcacaagaattgcgactccgaatgaaaatggtaactgcgccgcccggtgaatcaggtataaattcaatagtgcatcgacgcttgcacccaccgcattcaagaacaagacgctccccaatagcgccaagacgttcatgtgcacccccgcttccattgcttgtcgcacttgtcgtagcagttgacgaaatgtcgacgtcacggtgacagttgcggaaggtaattttagcgtttcatacccggacagtagcaccagaccggcaatcaagaacgtgattgcattcaaatatcccgcgagacgataatcgcccgttgcggccaatagactgacacccaacgcttggcccatcgtctgcattaacactccgataccttggttgatccctaaggcctcttcttgtaactcagacgcgactttagcttgtaataatggcattcggaggctgccgctcaacatccccaacacgtctgaacacaaattgatgacaataataatcaacagcaacccgacctgtttttcaggaataagttgcgctaacacgagatataatgccgcttgaacaaatttcaaacctgctaaccacccccgcttattgttttgcgagtctgccaatcgaccagtaagcacaccaaaaataccaggaagcacagtagccaccgaaactagcgaaaccatcaaatttgcttgtgcaaacgttcgcgcgtacgttaatagaataatgttaaataggctggtaccaattgtctcaaaaagatcagctactgttaacgtgacaaacgctcgattacggcctagatttttcataacgccacttccaatttaatattatttatcgcttaaataaatttaaatgataaagcaactttaatcgtttgatttctatttgtcaaatggttaagctagtattgaggtgaaaaatatgcccaaaaacacactggctcagtttgcaaagttaatggtcgatcccaaggtggccgctatcttaaaggccaccaaatctaaaactggtttaacaactaagcaaatttcagcccaaactaaaattcccaacaatcagttgtactacaccatcaataaaatgcaggatgccgacttattaaccatcgttaatcaagttcaggttaaaaatctaactgaaaactactattccagtgcccacctctcccatgagacgccacaggaattagcagatcttgatggtctcgatactgatctgactgacatctccggtacgtggactcaagcccatgtccaacaagttttacaatggatcatgctattgaaccacgactttaccgaagcctaccaggaagagatgacccgcaagcaacctgacaagtcagccatttttttcagtaacgcgatcctaaacctttcagcggcaggcgagcaccagttgcgcttagatttgatcaaattgcttggcgatgctgaaaagaatgatcctgatcctcagtcaacggacaagcgtcaggttaaactactcattgaaaagtggcaataactggaacatgcaattgttagtctttttggctaccaaagaatcactgactatccaggctagctaacgaccaaaacaagggtcagcaaaaaagctccgaatgactgataaatcgtcattcggagcatttaatattggctttaaaattgcatcaagctcaacatatcataatctttaatcttatcgcggccgtgcaaatctttaagttcgactaagaaagccgttccaaccacgttaccgcctaattcttcaaccatttgaatcgttgccgagatggtcccaccagttgctaataaatcatcagtaactagcacattttgccccggcttaattgcatctttatgcaaataaagtgcagactgcccgtattccaaatcataagtcgctttgaccgtttcgcgtggtaacttacccttcttacgagcaggtgcaaaaccaacgcctaattcataggccactggacaacccacgataaagccgcgcgcttcaggcccgacaatcatatcaacatgtttatcacgcgcaaattgcacaatctgatcagtcgcttcacggtaagcttccccgtcagccatcagtggtgaaatatcgcgaaaaatgattccgggttcaggatagtccggaatactagccacatacttttttaaatctaatgccatttgttcttaacagctccttcaattcttaaccgcagcctggttcttcacccatacttggagcgctgcagatttactatataaaagcgtttcttcagcaacgatttgttgttcgcgcagctgataactaggggcgtgatgtaaatccgcttttgccggattcgaaacgccattcatgacaccatcatttattttaacaaatccgacctcaaaaaacacctgaatcatgaaaataagcaaatttcgttcaatatgcagatgcttggccactaatgttaattgatgatgaatatcaacatcatggtgcgctgcggtaaactggaaaagtttcgcaaactgcgcgcgatttggcattcccgttaaataaaccgattcttgccgatataagtagagcgtcagctgatcgagcgcaattgtgctgagtacctgggtcatatccgccagcgtgtcaggacaatcgacaatgaagaccgcttgattagccgtcacggcagtcagatccgttttcgtatcccccacccatacggcttgcgcttgggaacctaaatactgttcaacttttttcaacagacgctggtggaaaaagaggtaaacccccggtgcttgaaacaaatgggccgaaagatgttgcgtccgggcgtcgatcacctgggtccccgtcactgcaatatccttaaccatgatttggggcttcgtctgaccgttccaagtattttcactcaactcacccactaacgtcacatcggtgggactcgcctgaatagccggcaaggcagtacccatcgaaaaaccgatagcatcaatcgtattggtgccatcacccagttgtaatttcaagtgttgctgatcactaccgatcgcgcgtgcttgcggaacagtcgttggaactaattcaaacaacggtgccgggttatccgttccaaagggggccaacgcttgaatatctgccagagttgccaaggttgcctcagctaatggtaacgtaccgtcaattggtaaactgacttgcgcattgtctgctaattgctgaccaaccgccgccgtttccatcgcttctttaagggttgctaactggtcggccataaccgtcagtccaaccgccatatgatggccgccaaaagccaccaacgactcccgaaccgggtcgatcgcggcaaacaagttatacgcttccacgctccggccactacctttgagccggccatcgtcatcctcatttaatactagggttggtttgccagtcgtttcgaccacgtggctcgcgacgattcccaaaacaccctcgtgccaaccatgcccggtaataactaaggtttgacgggtctcattttccggcgtctgtgcttgctcgattgcactggcactaattgtcttgaccaagccctggcgtttttcattcaattgattgacctgtttggccagcgcggtcgcccgctcatcgtccaaagttgtcaataattctaccccgctctgcgctgactgcaaacggcctagtgcgttgagacggggggcaataccaaacccgatattggtctcagtcaatttatcgggaatcagtccagcttcttgaatcagtgcggctaagcctggccgggtcgtctgctgtaagaccttcaggccgagcgtcaccaaagtccgattttcaccagtcaaactgaccaaatcagcaaccgtgccgattgcagccagatctaatagctcttccggtacttcctcaagcagcgccgtcgccactttaaatgccacgccagcaccagaaagaccgccaaatggatagttaccttctggatgtcgtgggtgaacaatggcgtatgcgtgtggcaattcagtcggtaattcatgatgatcggtcaccacgacgtcgatgccctgttcctgcacttgattgatgactgcatttcccgcgacaccgttgtctaccgtcacaaacagcttcgttccagccgcaattagccggtcaaaagcgtcctgattaggcccataaccatctttgaaacgatccggaatatagtaattcacgttagcaccaatttggtccagcgtttcatacataattgaggtactcgttaagccatccgcatcataatcaccgtaaatagtaatttgatctccggcaatcaccgcttcctgaatacgatcaacagctttttccatgtcatgcatggtcgttggatccaacaatggttgttgttcggcgtgcaggaatggcgtggcttcttccgccgtattaatgccccgcattattaataaccgggcaactaagggggtcacgctggccgcctcagctaacttatcaatatcggcttcatcaacggccgttgttaaacgtggcacccactttttctttgccgctaacatggcatccttcctttcaacaacttacttatccgctggcgtggttggttgttctgccatcgctcgtttttgtttacctttattattcaaacgcaacgttaattgcttattttcggcagtcaacttgtcaatcttagcctgggccgctgctaaagcttcactatgggctgtccgttccttagattcattgaccgtcgccatcagtactgcggtaatgacacctaagatcaacgtcaccacaatgaccaaaatcagtggccaatgaactgctgtaattccaaaattgattcgaactggttctacatttaaaattgcaaaaataatcactactagtgcaatgactagtgcactcactaaccgccattgattcttcattaaattcatcccctatttaaaattaaaaaccgtccccgtcagccaatccccgagcttgggtgccagctgataacccaaattagctgcagacatcacccaaggccgattcagttcgcgccgttgatgcccgagtttactgacaatcaattcagcaaacttaacgggattcaatgccaactgttcaacgcgttctaggtagtgccccgtgggatccgcaattttgaaaaagtccgttttaatgggacccggattgaccgtcaatacgttgacatgagcatccttgagttctaggcgcaacgcattatcataagcaataacggccgccttactagccgcataaacggctgatttaggcgttgcgattttgccagccatcgaggcgatgttgacaatttcacctgcgtgttgcttgaccatccgctgcgccgccagttggctaacatacatggtccccaacgtattgacgcgcagcatcttcaccatcaccgacgcatccatggtggtcaccatggtcatatcgccaaaaccggcggcgttcatgacgacatccaattgaccaaatagctcatcgatggttgcaaagacgtgatcaacatctgccacgcgacccacgttacaagcaatcgctacggcctgcccgtttgacaacagccgacattgatcagcaacctgtgttaaccgttctcgccgccgggctgctaagacaacattggcgccctgactcgctacggctaaggcgagttgctcgcctagcccactagacgcgccggtaaccaaaacagttttacccactaagtttgtcatttacttgacctaacctttctcaggtaatggaatatcaattacatcaaagtcgcgaacgactttcgagtgactgaagactttctgtgcttgtttttgtagttccttactcaacttacccgtgtaccgcgccgagatatgagtcaacaatagctgcttaaccccggcctgttgggccacctgggctgcttgggtactcgttgaatggtaatagttatgtgccaacttaccttcatcttttccgaacgtgctctcgtgaactaaagcatccgcatcctgtgccaaactgaccgcgtgcggtgtccgccgagtatcaccaagaattgtcaccgtccgccccttttgtggcgcagcgatgtaatcttgaccattaatcgtccgaccgtcaggcaacgtcaccgttttgccggcttttaattgaccatagacgggaccactcggaatgttcagggctttgagtcgatctgcttgtagttcacctgggtgatccgcttcttctacccggtaaccgaaacaagcaatccgatgatccagaggttcgcagcttactttgaacgtcgcatcttcaaaaaccgtttcagccttcgtgatttcatgaaacttcaatggatatgacaaatgggtgccagagacccgcaacgccgtttgaacgaagtcacgaacaccgactggcccatagatggtgagtggttcgtccccgccttgaaaagaacgcgagctcaataaccccggcaagccaaagatatggtcgccatgcagatgggtaatgaatatttttgcaattttacgtggctttaacgtcgtacgtaaaatctggtgttgcgttccttcgccgacatcgaatagccagacttcatttcgttcatctaatagtcgtaatgccgtgctagtgacatttcgaaatttgcccggtgagccggcaccggtacctaaaaattctaattgcatatttttgttcgtcctatctatacagtctgctaactattttaccgaatctagcggcaatacacaattgttagcactgcaaagtcatggccgagaagcaccgtgcgctcagcgaccgcaattctaaaaagcaagcgacgttgggcggctcctcacaattaacaggaagaacacgaacaacgctgctcatttcattttaacatgtcaggctaaaattatcgcacttggtttcaagattccatgcgccaagaccgcctgccaccggtgttatcgataatcaaaaaatgcacttttcgagcaacctgacgatgaccgattgtgaccgttttcattcaacccgtcatcatcggtgagcgagttcacagtccatcttgcttaacccaatcgattatcgtatacttgcttacaaatcgtccgaacaagagggaaccgttatgcgactcatcgactttaacttatcaaccgctgatttacagcaaactttaccactgtattgggagcctacgaccaatcaagcgtggccgatcaaaagtgtcacgctcgtcgaccaccagctcgtcctcgtcgccgcaaaaagcgtgacgccactgactcttgaccaattcaacgcacggacccgtcaaatcgatggtcaaacacagctgtacattcagacaacaccgcacccactccgattatttggctatcggttgagtcagcaacgcctgctatttggctgagaacccgattgcacgtgaactcaaaaaacagcgtcgttagttaaaattctaacgacgctgttttgcattgctcattttctgatcattggtttgcctagacgacagtcaaaacgaccgtcatcaacgaaacaggtcttcaccaaattttagtccataaactggaaggagtagtccaagatttgaatcgtatcgtcattcttggcacctgctgcgcgcaaggcatcatcaacacccatgccacgtaattgccgcgcaaaccgcattaaactttcttcatgatctaagttagtcatcttaaagagccgttctaacttttcaccagacagaacgaacagccctggttctggattatcaatgctaaagtccgcatccgcttcagtcgtgtaatcacggtgcttcaagtcgtcaacacccttgattgggaattgtggcgtcgtatccaacaaatcagccgtcttggctaacaaggcttttagtccctgttgtgtaatcgacgataccggatagacggctggcgtgtttggcaacgtatcatccgtcgctaacttcgccttaaagtcttccagattagcttcggcatccggcatatccatcttagtcgccaccacgatttggggccgcttcaagagatcagggtcataactcgtcagctcgtgattaattttgtgataatcctcaaacggatcgttttcttctacaccactcatatcaatcagatgtaaaataacgcgcgtccgttcaatatgccgcaagaattgaatccctaagccgactccgttagctgcaccttcgatcaaaccaggtagatcagccataacaaagtcacgaccgtcatccaaacgaaccatcccgagattaggcactaaagttgtaaaatgataggccgcaatcttgggcttagcactcgtgaccactgaaagcagtgtcgacttgccgactgaaggaaaaccaaccagaccaacatcggccaagactttcaattccattcgaatcgtcaattcatcgccgggctcaccattttcagcaatttcaggagcagggttcttagcgctagcaaaatgaatatttccccgaccgccccggccacccttggcaaccactaaccgctgatctttattgacgatatcgccaattaactcaccagtttcagcatccgtcaccgttgtcccaagcggtactttaataattgtgtccttcgcggaacgacctgtcatctgcttaatcattccattgccaccagctgcagccttgaacttccgcgtataacgaaaatccatcagtgtccgtaatccttcgtcagcctgcaatacgacgcttccgccgcgaccaccatcaccgccagcgggaccaccattgggaacaaacttttcacggcggaaagcaaccatgccgttaccaccgttaccggcctttacatctacttttacttgatcaacaaacatgttcttttctcccgtttcttctatattattatctacgaaatccgatcgtgcgaaattagatacctgacctagtatacaaatcttcggccacttcgtcaaaagttccacgcctaattagacagatcatctttatttggatgctaatgacgatttgatgacagattttggattattttgacggcttttgaaggtttttgttgcattttgacgtttaaacaggtatattattatgcggagggatttgaaagtgcttacagaagaacgtcaacagtacattttaaatacgatccgtttcaagggcattattaaaatcaaggacatctgttctgaaactcgttgttccgagtccacggcgcgccgtgacctccaacagctagaagaacagggcgagttactccgcgtgcacggtggtgcgaagtatatgaactcactccaagaggaacccgcgatgaatgataaggtttcccgtaacgttaacgccaaggaccatatcgcgcagcaagccgttgcgaacattcaagttgatgacgtcatttatttggatgctgggacttcaaccctagccatgattcaccatttaaatccgagctacaacttacgtgtcgtgactaatggtgttgtccatgcttccgctttggcagacatgggcatccaaacctacctgcttggtggcaatttgaaaggcaccaccaaagccgtgattggtcccgaagccgttaaatcgttagaggaataccgattcaacaaagtttttcttggtatcaacggtgtccacccaaaattcgggctcacaacgcccgaccccgatgaagcggtcgtcaaaaaaaccgcaattctacaaagtgaagaaagctttatcttagctgacaacactaagttcgaccacgtttcgtttgcgcgcgtcggtgatttatccagtgcaaccatcatcactgaccaactcacgccaagcgttgccgaacagtatcaaccattaactacgattcaggaggttcaatcatgatttataccattactgtcaatccatcaattgactacgtggtgcaactaccccaaatgaccctcggcagcgttaaccggttagcacataccgcaaagctgcctggtggcaagggcatcaatgtatcccagattctgaacgacctagaccaaccaaacaaagcactcggctttatcggcgggtttaccggcacgtttatcagtgatgcgttaaaagctaagggcctagattgccacttcaccccaattgccgatgatactcggatcaacgtgaagattcacgctgaagaagagactgaattaaacggtgctggtccggacatcaccgccaaagagatcgacgccttctacactgaattggccggattaacgccggatgacgtggtcgtcatgtctggtagtttagcgccaagtttaccggatagcttctattatgatattatccagaaggtcgaagccgctggtgctaactttgtcattgacacgaccggggaagctttgaagaaaaccttaccaagtcatccgctcgttgtgaaacctaataaccacgagctcgctgattattaccacaccacatttaacagccaagctgatatcatcgcggctggccaacggatgctagctgaaggcgcacaacacgtgctgatttcaatggccggcgatggtggcctcctgatcaccaaggatgcggtctactttagtcccgcaccaaagggccaggtaatcaactcagttggtgccggtgattcgatgattggtggcttcgttggcacgttcgccaaaacacacgatgccgtcgaaagtttccgctatggtttagcctgtggctccgcaaccgccttttcagaagacattgcgactcgcgctaaaatcgacgaaattttacctctcattaagattgaaaaactcgctcactaaagaaaggactgttaccttaacatggatatccgcgatttattactaaaagatgtcatgatcatggacatgcaagccacgaccaaggacgaagcgattgatgagttagttcataaatatgccgaacaaggtgtcatcaatgacgaagccctttacaagcaagacatcatcaaacgggaagccgaatcaacgaccgggattggcgatggaattgccatgccccacgccaaagataaggctgttaaccgggcaaccgtaatgtttgctaagagtaaggccggtgttgacttcaatgcgttagatggccaacccgttcacctcttcttcatgattgctgcccctgaaggtgccaacaacacccatttagctgccctcgccgccctctcaagcttattgatcgatcctgaattggtcgctaaacttaagaatgcacagacacctgaagaagttcaacaactcttcggtgatgcccaggctgctaaggaagaaaaagaagccaaagatgccgcggccaaggctgaaaaagaagccgcagctgctagtaccaccactgacgaaaagcggccctacttagttggggttaccgcttgtccaaacggcatcgcccatacttacatggctgaagcagccttgatcaaggctggtgaagcggccggtgtcgacatcaaaatcgaaacaaatggttctgaaggtgttaagcacttattgaccgccgatgaaattgctcgtgccgacggtgttgtgattgccgctgacaagaaggtcaaaatggcccgcttcaatggtaagcacctggttaaccgtcccgttactgatgggatcaacaaggccgaccaattagttcaagaagccttgagtggtaaagcgcctgtctatcacgatgctgatggtggtgccgctgatgacgatgaaggtggcagcgcaaatggtagcgtttggggtgaagtatacaaagacctcatgaacgggatttcccacatgttaccattcgttgtcggtggtgggattttaatggccctctccttcatcattgaacaattcgctgggagtaagagcttagcctttaccttcttcaaccaagctggtaacatggccttcgctttcatggtacccgttttggccgggtacattgccgaatcaattggtgatcgtcctgccttgatgcccgggttcgttggtgggttcatggccacggtctacactggcgcttacggcggtgtttatacggcttcaattaccgctaatgctaaaagtcctgccgggttcttaggtggtttagccgctggtttcttggctggttacattaccgtttggatgaagaagtggaccaagaacatgccacaatccttagacgggatgaagccaatgctgatcttcccaattctgggcttattgattattgctgcgctaatgttcttcgttgttaacccgattttctcagtcatcaacgcttggattacccacttcttgaactcaatgggtactggtaatgccgttctcctcgggcttgtcctcggtggtatgatgtcgatcgatatgggtggtcctttcaacaaggccgcttacgtcttcgcaactggtgcctttaccgcaactggacatgggaacttaatggccgctgttatggctggtgggatggttccgccattggcaaccgcgattgcaactgccttctggccaaagaagtttacggatgacgaacgtaaagctggtatctctaactggttacttggtatttccttcatcactgaaggtgctattccattcgccacggctgacccgttgcacgttatcggttcaagtgtaattggtgccgctattgccggtggtttaactcaactttggggcgttgccgtccctgctcctcatggtggcctctgggtctcattactcgccacgaacatctggggttacatcggtgccacaattatcggtgccgttatcgctggggttatcctcggtctatggaaacctgctaaggcttctaaataatacgatatccaaaaagacgatcaacttgatcgtctttttttgttttcaaaattaacgaatcagtcgtctaaccccgcaataaaacgggtataatgaaactaatataccgattatgttaacgagaatcgagacgagtttgatgaaactacgaaaatctatctttggcatcggctgtgtattattcggcatgatgctgctttccggttgccaaaagcaacctaaaacggctctgcctcctgtcagtcacaagaccttaacagcgatggtgatcagtgatgaccatgtcattgcgcccagcctgcatgataatggtaaggcttttacgcagtacgcggctaacgatgccggcgcggatttaaaatacagtgtgacgatttttcgcgcttttattgctaaggcgttaatcaccaagcctgacgttgtgctcatcagtggcgatattactaacaacggtgagaaagccagtcacgagtacgttgccaagcagcttcgccgactgactgctaagcacatccgcgtctacgtcgtccccggtaatcacgacttgaacaaccccatcgcccgtcgtttcaaaggaaagcatcaatatagcaccgaggcgactagcccgacccagttcaagaagatctatcatcaggccggctacggccaagccagtgaaactgacccaagctcattgggatatttggtaaaacctagtaaacacacttggtttttgatgctaaactccgccatttataaaagtaattatcaacaaggtaattcaacggtcggtggtggcctgaccgatgggaccttacaatggcttactaaagtcggtaagcaagcaaaacaagcccatgcgactctcattcccgtcctacatcacaatacaatggaccacacggtgattcatcaggactatacaatcggttatgccgaagatgtccgtaaggcctttaccactgcgggtatcaagttatcgctcagcggccatattcatgctcaaaatatcaagtctaccaaagtcaagaaccagtcactgactgatattgccagtggcgccctgatactgggatctcactattacggtacgcttaagatcaaccagagtaacgggacggccacgtaccacgcgaccccgttaaacgtgagtgcttacatcaagcaccaccgtggtaataaagcgatgcgcgcctatcaaaagtacgatcatgacgtgttatatgcggctggctataacgcagcactgagtcagttatatgaggaccgtgacgaaacgcaactatcaagcgctaaagttaatcagttagcccgcggcatggcggccgccaatatcgcgctctttcggggcacgccagtcaaaaacaccgccgacattcaggcctggcaacaaatgccacaaaacacgagtttgcgtggtttcgtgttagccactaagaaactgcatggtaacgtgacgtggtctggtgccgtacgataagcgatttataaactaaagacgacagcaagtattcaggctgtcgtctttttgactattcacgacttactgattgtggatcatacccgcacatcctacctcgattcgactagttcggttttcgcacgcgtaacatttgcttcataatcgtcattaaataattacgcttgataagtccgccgacgcccgttattaaaatcaatagataacggagcaccacactgtgataggcactcaaaaatagaaagccggccgccaaaaaagtgaacgtaatcagtaccagtatctttcgcttatatggaagcgtgccaagttcttcacgacagattcgattcataaaccaataatgaacagctgcatacatcacatagcaaatcaaggttgtgtaccccgccacctcgtatcctaaaattggaatcaaccaataatttaaggccacattcagtaccgcgccaatgacactggcaatcataattaaagatgtccgttcataatagaattcaaactttgcaaataaatcaaaggcaaaaatgaaaaagacactcattgcgatcggtggaacgatccaggtcgccctagcatacgctcgtggtgcgaatatcgaaacgatttcaggcgcaaatgcaatcagtagcaagttgacaatcgcaattaaaatcagagaaccataggcaacacccgcaatatcgggcacgcgtcgatccttgattttttgatacatccacggactgagcgtttgtgataaggcaacgttaaataaaatcatgatttgcgaaagtgagtacgccaagctatagatgcccgcactcttcgcattgaccatgttaccgatcatgatccgatcggcactactcaggacaatctgcgaaagataatgtggcgctaacggtaggttgaacattaacgcgtgtcgccaaaaatgtcgcgagaagaacgttttgccacgatacatttgcacaaaaaacaaacccgtatagcccaccaactctaccaatgctagtcctaaaaaccgggccgtcactttatcattcgcatatacaaccagcaatacgcccactactggtttggcgactgcgaccagcaaagtcaccaccaccaatgatttgtattgcaaggtgacccgtcgctcaccggcccaaaaattaaaaactgacgaggtccataccatcagcagcatcgccagcatctgcgtcgtcgttaaagaaaaaacgttattccaaaaatcacgaaacccaagataaactagcgtccatgttaacaccaatacaaccgttaatccttgtaacgcggccgaatatcgacgccgatcgtggctgaacttgatcagtccttgggtataaacgccatagcacagatttagtgaaacaataatcgtgacgatggtcaaccaggaatacagcacattaaattgaccatactcggaagcagacatgatcctggtaaaaatcggcgttgcgattattgaaatactcttttcaaaaaaagcacagaccaggaaccaaagcgaagccttaacttgcttaggaaaacaccggtatttattcttaatgctaactaacataagttcctctctcatatgcttgaactaagtatcacgtcccattccaaccaatcccttaaccactgacacgttagattgatgggttactaccgataccggtgcccgttgatcgtccaaatcgttcttaatcgtaaatagttgatcacatagtaacaattatctggtgatgtcaccatggcgcggactaaggcaaccaaggcctgaccaagtttccgtttgcgcaggctggccatcgccagcgtaaaatgtttttgcccacgattaaacatgctctgggcacgggtgtcatttattttttctgctagcgtcggtaggtcatgcccgaagctgtccgcccccgtccgttttcgttccgcatataattgctgaatatagcgcgataccaaataggtttgccacgcgttgctagtcatactattaccgcgcaaccggtagtgcaacacccgttggttaatcgatccgattttgaacccgcccgcaagtagccgtagccagagatcatagtcttcagccgtcggtaataatcggtaaccaccgacttgttggacggccgttttccgcattaagacggtcggatggataatagttgaaccatagggtaggattttttgaatcagtcgttcagcctccggaatggccgacttctccccgacgacctcaccgtgttcatcaagataagcaatatttccggagattaagtctaacccgcgcgttttcagcgcctctaattctaattcgaggcgcttgctggcagaaacatcatccgcatccatgcgcgcaatcagttcacagtttgaaagctcaattgccttattgaggctagcagccaggccgagattctgatgattgcacactagtttgatcatttccacgcggttatcataatccgttaacaattcttttaaatcactgcgttctggattatccagtacgatcacaaactccatcggcaagtaggtttgcttcaaaatcgagtcaaccgcttgctggacttgctcgggtcgttcattatatacactcataattacgctgattgccattttttctcctcaatcttcaattcagttgaaagtaaataccccaagaatatcatcgtcgtcagaaccatgccgctgcgtgcaacctcacctttataatttgcgattaggaggactattccaaaggcgaggaagattttactctcccgaacgacttttccagactttttatggcaggccaccaaagaggcgatgatcgtactatacgatagcgccatgtaaacgatgccccccataaataaatcattaataaagccaatatcggacgttccaaaccaaatattgctggcgttgccgccatatacgcgaacgccatagccaaaaagccagtctaaaagctgacttggaaacatcaagaacgagcccgtcagttgttcgtaattgccctgcttactaccttcaaagacgagtgcaaaggtatcttcaaagccactgacgatccaggtatacgtatcaggttgaatagactgcagaaacgctaagcccagtatgataaaggtcacactcaatatgataatcagcacaacttgaaagagcccgcgcacgctcgagaccatccgtttgaccagcatcaaagcaaaaccaaaggccagcgtgatcaagccggtgcggccgtttaatacgataataaagacacaaaatggcaggaaccaataatactttttgccatggttcattcccggatatatcgcaactagtcccattagactatggtagattggtgtgaaaaatgtgtaatcactgctgattccatacaaacgttcaccataaataaactgattttgaataataccagtagctgttttagctaaaattgcggcgcgaatacccgaacttgctaacatgatcaaggcaaacaagcattgaacgaccaccatccatagcatccaggtcaagaccgtttcgcttgtcacgttaaaatacttacgaagaacctctagccataacaccagggcaacgacgttcaaaataatcacaatattttgaaacacccggggatcatttcctgccagctttgccctgaacgcaaagtaaatgaccgatagcatcacaccgatgacaaaaatgtgcagtcgattgatagcaatcgataagtcctttggcgacaatagcaagacgcaaccaccggtaatccccagtgtaactatcaggggcacataactactgctccaaaagttgggttggtaaatcagataaaacccagcaatcaacagtcctactcttaaaaaaggcccaccaatctgacgatttaatgcagtcatcgttccattaccccttcataaacttgctggattcgctgaataaattgcctttgttcatagtcactaaaatcgaccgctgctattttagccttggtttcctgataaaatttttcatccgcaaagagacgtgtcaatactgcgagtaattcattatcacccgcataaacaatgccattgaccctcgcggccgtttgagagatgccaccaatgcggggggcgcacggaatcgcacccagtaaggccgcttcaaccatggtcaatccaaacgcgtctgatttggacgtcgacagcacgactttggcatgccgcatgtatttataagggttacttttaaacccgagccagcgtatctgcggggtggctgcaatctgtttagcgatgtgtgtacgcaagctaccatcgccgacaatcccaatctttagttcaggaatagcatccaataatttatgagcaattctcacaaatcttgcgggatctttgacatcttccaaccgtcccacgaacaacaggtcaaatgcagtggttgtgctggtagtagccagttggcgtattcgcgaactgtcgatcccattgggaacaatcgttgtattagttaaatgatcgtggaagcgatacgattctttggcccaatctgaaacatataagacccgtgagctcttgttgccgatgtattgaaacgccacacttctccagttcacactagtctgccatactggagcttgatggatatgggtaacaattggcacatggtgaaaaagcagattgactaaaaaactcgctttgaaatcatgtgcatgaataatatctggttggagcgccataatagctcgcctaaatttaagaagctgtttcggcgaaaaactttgatacgcgatcccgaccgcttgtaagctttcttgtattgatcctgcttgtgaacagtaagtgaaatcatagaattcacttaaacccttactaatattaatgaccacctgctcagcaccacctaatttggcggaaaacaagacatgaacgatttttgtcatcgacgatcgccctcctaggctaagcaacgcaaatagtacgcctgcgtttgttcaagcatctcatgctcagtataatgtcgttgatacatttgataggaattagtcttgacctccgcaatttttttcgattggtagagtgtcagaatcttttcagcaatctgttgtgcatcattagggaccaaaaagccattatgatcaatcaattcctgaatacccccgacatttgatgcaataattggcagaccttgagctaaggcttcaactaaactgatcggtagggcttcataatcagaaatcagcaccccgacgtccgattgagaataatatttctgcacattatccaccaccccataaaactgcactttagtatccaggttcaactggtgcgttaacgttttacaggcttcgattgcagggccgtcacccagaaaatggcacacgatcggcagattctcaggtaggtatgtcagtgcttgaatcaagagatcctgccgtttcggcgcgtcaaaacgtgccgccatcgataatacaaaggtctcggtactgttcaccttttttgagcccactaatgcggtcacgccattatgaataacacgtgcaggatgagcgctagtaatcacaccactttggacacccaaatcataatcaaactgtgagacacagatataagccgttgtcagacggcttaatgctttttcgatagttttcatcaaaagctgccgttttttcccgacaccaggtgtaaagccccaaccatgaacggtgaaaatgactttcattgccaatctagttgttgccagtctaccaatcataccagccttcgaagaatgcaaatgaacaatatctggctgccaattttgtaataatttccttaacgtgctgattgcttttaaatcactcagcggtgcgattggatgcaccaggctggcaactctgaccacttgaacgcctggaaactctttcgcgacacttgcactcaggcgtccttcaacgccgtatactagagcaacggtattaccacgcaacacctgagccttgatcaaactatacagatgtgcctgagccccaccccaagtcgcctgggtaatcacataaacgattttcactaccgcgcaccatccccggaaataatcaccctaactgtccccatcagcatcttgatatcaaaccaaatcgaaaagtgttcaatgtaataattatcatattgacacttggcacccggtgtaatatcgtagccaccattgatctgcgcatagccggtaattccaggaataattcgtagccgtttgggaaaatcaggatggcgttcactaaattgttcagtaagttgtggccgttccggacgaggcccgaccagactcatatcacccttgaggacgttccagaactgtggtaattcgtcgatccgagttttacgcatccaacggccaatcggcgtcacccgcgggtcatttttttgtgcccacaccgcacccgtccgagcctcagcatcctggtacattgatcgtagcttaatcacgtcaaaagtcgttcccatccagccgactcgctcctgcttatagaaaacgggaccgtcagaagtcagcttgataagtaatgcaaacacaagcacgatgggggcactgaggagcgtgccgactaagccgaccaccagatcaaaacaccgctttaagtccattttccagccggtaactgggataccaatattatgaataaattcatactggtgttcatcattagcaattgattcattgagctcaacttcgtgcatgatcacgttccccctcccagtacttagtcaaaccccttctcaaaggccattccgactcataattcaaacgtgccaacttaccgatgcttgcaaccgaatggtcaacttcgccaccccgttgttcagcctgtttgatttcaagttgttgaccggcaatctcctgatacatctgaataatcccgtttaagctagtttctaagccgttggcaatattgatgacctgatgttgtactcgatgttccgtaatcaaacataatgccttgataacatcactcacgtacacaaaatcccgggtctgcgtcccatcaccaaacagagtaaatggccgctggtttttcaagcagtcggtcagaatcgacaacacccctgaatacggcgaacttgggttttgacgtggcccataaacgttgaagaaccggacacaaacggtcggcaaatcatacagctcgccgtacgctaacacaaaccgttccgtcgcatacttatcgatggcatatggcgataccggtgcgacgcgtgaatcctcgcgtttcggtagttcaggtagattgccataaacagccgccgaagaagtgaatagaaattgtttaataggcaggcgaatttggcgaatatgttcgagcaagttaaataccgcagtatgattcacagcatgcgtttcagctggccgttcgatagaatccgcaacgctcgcgattgccgctaaaaaataaatataatctggtcgctcgtctgccagtaactgttgcataaattgatcgtcacaaacatccgcgacataaatcgtgacctgttcccaatacttaatattactgatggcccccatggacagattgtcgaccaccactacttcaaaaccagattcaactaaatgatcaaccaagtgcgagccaatgaaaccagcgccccctgttaccaatgctttcataactatttacccctctcaaaaaaaccaaaattttcgtcgttgtttaggtcgcaagacttcccctagcactactggatccccgttcagtagtagtcttgcatttgttgcaaaataggcaggattacgcccgtctaaccgtgctaatgcttgataacctgctcgcatcataaatccccgtcgcgccataaaatgcgcatctgaagcaatcacctggaccagtccacactcgactaattccagtgctgtacttttgacagcttttccaaattgcccgacgaggctccctgctgtcagctgtgccaaacatccctgttgtactaaatcatagagttgctccggccgagccataatctgagcattgcgctctggatgggcaattaccggagtcgtcccgtgttgcaatagttcaaagatcacttgggcggtgtaatgaggcacttgctcgtgtggcaattccagtaacaaatagcgacgaccagcatcaatgcccagtagttgtgactgagttgtcaccaaatcatcgcgcaaatggacctcctgaccagcaaagatggtcagcggaatttgctgctgctggagttcggcttgaaattcaataaccgcacgttccaccgccggaccggcattctgatagtgtcgatccagatgatgcggcgtggctaggacataacgaatgccatcccccactgcttggcgggccatttcgaccgcctgatcaagctgctggggaccgtcatccaatcccggtaacagatgacagtgcaggtcaacatactcagttggtatcagtcccatagtagccgtacccataaccgttagttttgatgtccacgtcatttaaaacagccccaagtagctgtgtgtgtgcattcttcagggcattgactgcttggcgaaccgcaaccttttccacaaagttctgacgaacgaccaggacggtgccatccacttgaccagctaaaatccgggcatccgtcacaggcagtaccggtggcgcatcaacaatcactaaatctaacttacgtgtggcgaccgttaaaaattcggtcattttgttgcttgccagtaactcagctggatttggtggtttgggaccacttggcatgacaaacagatgatcaagtaccggatgaatcgcatcgtttacgtctactaattgcccgctcaaccacgagctcaatccacgttgattacttacaccaaatgtctgatggatcgttggccgtcgcaaatcagcatcgacaagtaggacttgcatgcccttcttcgcgtattccacggctaagttgccaccgattgttgatttaccctcgccttgaaccgctgacgtgatcatcagtgttttcagtggcttgccgaccattgaatagttcaggttcgtccgaattgtttttatctgctcagtcacaactgacattggcgctgtcaaagccgtcaactgtatgctggtagacatattcgtcacttttcgcctcaatttcattaccattcgttccccttatgttaaactcgcttgattgctggtttggccgcagatttcactggccgctgtttaattgctgcttggtcgtttgtcgctataagtggctgttgatggttcacaattcctagactggttagcgttagttcctccgctaagtaatctaacgtctgcacccggcgattagataagatccggacactcgcaaccgccaaacccagcagcaggccccccgctaggccaattaagatattaacggctttcttcggcgcgaccggcgtatctggtgtctcagctgatgcaacgatcgtcacgttgttgaccttaataatgtgctggactcgctctttaaacgtcgcggcgatttggttagcaattatggcactagctttggcattctgatcacgaataacaatcgagaacacctgagaattcgcgatgctcgtgacgctgaccgcttgcttgagcgtctcaagcgagcgtcgaatgtcagcttcctcactcaaggcctgccgcgccggcttcagcacgaccgagtttgtaattaactctttgtaagtcgtaatcatctgtacatctgcttgttgccccgttaattccgcagctgtgctactgtgtttgcggttaactaatatttggacattggcttgatatttaggctgtatgacccacaaagtcaccactgtcgcaatcaccccgcccaaaatcgttaaactcagtagcactcgccaatactgacggaaaagtttaaccataaaatcaaaggttattatttgctccattccacacgctccaatacttcttgattgacctttactaaacgattgtcatttattgtagaaaactaactgcaaatcacgcaacagttttcatgatttttcatgaaactcatataaatacaagcgaatatttgttgattcccatatttaaattggcattaccaaccgtagtgttatatttattgatagttactagtcgaaatattataaaacgtataatattttgactttttttattggcgtatttttcatcaattagtgttgaaaggtgccgctataaggtcaaaaacaaccagctaaggcccgctggaaaaagttcgagttcacgtaaacttgcttggctagcatcgtcctacgccgactggaaggcattcgaatggcagacggtgagggacccaacttttggtgaattcgtcattgtttttcataaacaataattttatcaatcaactgtcagggtgaaaatgatattggaatgtctcactattcctcaatcaacatcgtaataattgaccgtctcgacaaaatggttaatataaccctaacgtttcgtataaagttcccgtatcaaaatagccaacggccaattgtacccagttaagcggccgttcatcagccattcgagcggcttaccgaaacgtgctcggtgccactgaaggctgtgcttgctacgccaacggactaatgccaagaccgcattaatccattggctaggcaatgctcagcttcaacccgtggcccctcacactcttgagaccggaggggctgggtgacaatgctcagtagccaaattattcttagttggaagtgattttcttccggcttagaataagactcgtatttgagatgacgcgggttatgcgttagctcaaatcgacgtcggctgcgttccagcaattgtcacccagccccggaggtcggaataggacgcgcacatgctgaccaacaagcatccgaggccagataccgacacctttcaacaatttttcgtgtatatgcttaagccttcaagtttgtctgtgtaccaatacaaataggctttccaagacacagttcgtcttggaaagcctattgatgagtggtttatcgctgataactggggtcactgaatgacaagtcctgccacgtcacgctagttttcaactttttgattaccaaaccatttcttgttgatcttatctaacgttccgttagctttcaacgtctttaggccggcattaattttgcgtttcatcgttttgtcacccttacgcatcccgactgcgaagtcttcggacttaaaggtaccttgggtttcttgataatccgcggagtttgcttcgtgcttaatataatagctcgcgtagacgctatcaatcaagagccccttaattcgtccagcattcaagtcgaggaaggcattcgtgaaggtgtcgtattgaactggcgttttcttagcgattttgtcctttagtagctttggattgttctccaatgactcatagcccgaagaacctgactgaacacccaacgtcttaccagtcatatcgtcaaatgagttaatatgatttttctttaaagaaacgaggacttgcttgttcttcaaataagtattactgaaagccaccactttttcacgttggggatttttcgtgtagccgttccaaatcaaatcaattgtgccattgcgcaattcggtcgcattcatggaccagtcaatcgtttgaaagctgatcttaataccgtacaacttaaagacggcccgggcgaggtcgatatcataaccaactagtttcccagacttttcgcgaaagcccatcgggacaaaactgtcgtccaaaccaacgacaacgtaaccgcgtttcttgattttagaccaagtatcttgggtatcagcgcgtttagtcacattttgaccacagccacttaacgtcgttgccatacccaggagcatcacaacgatcaaactgagtgcaaataatcttttcttcattctgacgcccccctattgcttcttggttggttcaacgtggaacatttcatccgcgatattttcagcaaaggttaaatcatgggtcaccacaatttgagtcatgccatcagcctttaagcctaaaatcaacttttcaacttcctgtcgtaagttcgggtcaagtgctgaagttggttcatcatagcataagacattcggtttcatggctaatgcccgggcaatcgccactcgttgcttttgaccacctgataattcgaaaggatactggtcagcgtgatcaccgagattcaaacgatctaataatgtctgcgcctgctgttctgcttctgcgctagactgctttaagaccgtggtcggtgctaaagtaatattctgcatgactgttaaattgggaaacaattcaaaattttggaatacaacaccaatcacactatcgttactccgattagtataggggtcaaatggttggccgtcgactaagaactcaccggcattcaccttttcaagccccgtaatacagcgtaataacgttgtcttaccagcacctgaagggcccacaatacttagaatctcgccatccttaacggttaaattcaaattcttaataattgtccgtgaaccaaagctttttgtaatattttttagttctaacatatgatggcctccctatttccagtaactgtaatgtttttcgattcgtccaagcacaaaagtcgttacggctgtcagtgctaagtaaatgattccgactaatactaagggtaccaaagtaacatcgcgcgctgtcgcaacgttaccggcacgtaacaagtcgccgagaccaatgacataaactaacgatgaatccttgaccaagttgatgacttcattaccaactgacggtaagacgattttgatcacttggggaatgacgattttacgaatcgtctgccagtaactcaaccgtagaacccgtgcactctcatactgaccattgtcaattgactgtaacccgccgcggaagatttccgcgaagtaggccgcgtagttcagaataaatgcgaacaacgccgcgtagtaccgtggaaaaacgatcccgatcaatggcaagccgtaaaagacgaagatcaattgtagtaacaacggggtcccccgcatcaaccaaacgtagaaatgcaataaccattgcagcggcttgaagttagacattaagcccaggccaacaactaaccccaatggtagcgacccaatcagggtccaaatgaaaattttcagtgtcataacggcaccggataataatgatggcaaaatttctgaaatatattgcatgtgctttccctcccaaatttacaggtcacattgtcctgcgtccactaatctgtcacgacccaagccaataaaaaagtccccttgagtcgaatactcaagaggacggttatccgtggtgccacctcacttcgtaataacttcacagttattacctcagggagtttcgtgataataaaaaaatcgtcctcttaggccaacatacctaagaggacgatttcatcgcggttccacctcatattcactagttgctcacacaactaatctcaacgagtttatcactaaactccgccgctaacgaggccaaccgaaacagcttactaacttcagctatccaactcacagatgtggttcgttgtaatccttggtcatcttcccatcaccgataactcgcttgacaaggtctttacaactactcttctgttccctgttttttaatgttgaattcatactaatcgaaaattaatcaaccgtcaagcctttttttacttaccacggtgaaaaattccggcgatgcgtgaccagacacccggtttaggcgtatccaaattcattaacggcaccgtttcgccttcgatgcggcgagcaatattacggtaaccttgtgaagctgggtttttgggatcaagaacgatcggctcaccgttatttgacgttcgaatgacggcgtcgtcatcgaagacgatccccaacaagtcaatcgacaagtgatgggtgatttcatcaatatccatcgtctcaccatcttgcatcatgcgcgtccggattcgattaatcactaacttaggtgcttcggctaacggatattgttccaataagccaacgacccgatccgcatcacgaattgctgaaatctcgggtgtcgagacgataatagccgcatccgcaccagcaatcgcattcatgaaaccttgttcaattccggcgggacagtcgagcaaaacgtaatcaaaatctggtttcaactcgtctacgattgcccggacttggtcaggattcaatgcatccttgtccgcattttgtgcagctggcaataaaaacaataagtcatcaaaccgcttgtctttgaccaacgcctgccgtatttgcgcacgaccggcaactacatccacaatatcataaaggatccggttatcgagacctaaaatgacgtctaaattccgcaatccaatatctaaatcaactaagcaaactttcttgcccatcaaagcaagggccgtccctaaattggccgtcgtggtcgttttgccgaccccacccttaccagaggtgatgacaattgcttttcccatcaaacacgtcctccatttcgagtaaatagcttcggtcgtacccgttttaattgctggagcggctggtagtctaacgcttgaatgtcattaatatagacaacgttcgtcccatcaacgactttttcaaggtctactaattctaacaattcaccgactcgaacccgtgggacagtagctaaggggctaacgatcaccgcatcattatgatcgggataaccggcctcaagcgcaccgttgacctcacccatcacaaagatactacccgttgcccggagcaccccgccttcatggatcttaccgaagaacagcacgtcccccgtaatctcaacgacctgaccgttacgaatgatctgattaaccagatgcaccgtatcacgttcaatcatcgctaaagcatccgccgtcaaaataacgtcagccgttaacttgtgaatgctgaataacgggtatcgttgaattaactgggttactttctgattctgttccgcagtcagtagtcgattagccgtatccaggtcaaacgagatttgtttatcagtcgtattatcagcctgcaaccgatctaacaagaccttcaagtcgaccataatatcgtcaaagcttgcttcttgccgtaaaatcagttcatagccatcattactggcctttaaaactacactctgttgcatgttagaattcctttctgccgactaattaacactcagatataaccgacgcattggataatataatatgacaaagatggctaggttgaccgcaatcgtcggccctagcgtgtacactgcaaagtccgctaacccactagagatgacgtggctcatcgtgtaccaaatatacgtaaacgcttctaaaatggtcaaattaataatatagatcatcagtaacgttaaaaagttcaagtcgatccatggtttgatttgccgacatatatagactactaacggtaagccaatcatgtaaacgcctaaaattccagtatagtaccagtcaaacaccaagcccacgaatgcggaccagattccaaccggcagattatcacggtcatctaaaaagacggcgaagacgatccacagtaaaaccaggtgtaagacactggcatacgggtaactaaatagcttagcggcaaaaacgtttgaaactgagccgtctaaaaagagtgcaacaaataacccaattggaaagatgatttttaatcttgagtaacgcaccgttgcacctccctattgttcagcgaccgtcacaactgttaagtcactgaggtctgctgcgggtgtgatttccacttcggatgctaacccgtaatcatcctgcttaacgctagcaaccgtgccgacgtagaggccttttggcgtattaccgcctaaaccactcgtcacgactttatcgccttttttgatcttaacgttcgacgtcaccgagcccatctctaagaggttgctactcttatcatagcctgaaataatcccgttaacggtcttgccagcactattggtaatctgaatggcaaacttattcgaagatgaactcgtattggaaatcaattcaacctttgaatttgtttggttgacttccacgatccggccgattaagcctttttgtgacataacgggcatattcttcttcacaccggatgttgcaccctttgaaatcacgagttggttcatccaagacgatggtgtccgcgtcaaaacattggcggtcaccgtcgtataatcagataacgaattattcaatttcaactgcttgcgtaactgcttgttttccgcacgcgtcgtctgggcactaaccttagcctgcgccagttggtcaacttgcttcttcaatttttgattttcttgataggtgttcaacaagtcagaaactgagttggtcgcactttgtaagccattgactggccaagcaatcacccgatctaccgcaccggccacgtcgttaccaaattgttggatcaatggtggtgtcgatttcttatcacgaatggctactgagacactcatcaagccgaaactaataatgaacacgacaatcgcaatcactagttttcggttagaaaaaaacttttgcataatgaacccccggtcgaaaattcaatgatttaacaataaagaagcgggaagacgtcttcccgctcacctgttatcgctttttcataacgtcgatgctcttgagtgattcaccagtcccaactgcaacacagtcgagcggttcgttagcgatgaaaaccggtactttggtttcgtccgcaatcacttcggaaagattcttcaataaggcaccaccaccggtcaaaacaatcccgtggtcaattacgtcagaggcaatttctggggaagtttcttcaagggtttctttaatggctgaaataatttccgagaccacttcttggatggcttctgaaacatctacggatgagatttcaaccgtcttcggtaagcccgacaaaagatcgcgtccacgaatcgttgacccttccaagtcttcagcggcttccaaagaagctgagccacagtcgattttgagttgttcggctgtgcgttcaccgattaaaagattaaacttctggcgaacatggtaaatgattgagtcatcgatcttatcgccagccattcgaattgaacgacttgatacgatcccacctaaggaaattgtcgcaacatcagtagtcccaccaccaatatcaacgaccatgctcccagttggatccatgactggaagccctgcaccaatagcggctgcaaatggttcttcaatgacatatgcatcccgcgcacctgcaacccgtgttgcatcaataacggcccgcttttcaacttcggtaaccccacttggtacacaaaccatgacgtatggcttaccatttgagcggccgagtgtcttttgaataaagtacttcatcatcgcaacggtcgtatcgtagtccgcaataacgccatccttcattggccgaatcgccacaatgcttgctggggttctcccaatcatatcccgtgcttctgaaccaactgatacaatttcaccagttttcgtgttcttcgcaactacggatggttcacgtaatacgatgcccttgccgtcaacgtacacaattgtgttggccgtaccgagatcgatcccgatattctttgtcccaaatccgaacactacattcatcccttcatcattaacaaatttaattttttatttagtcataatagtaagtattatagcatagtcgcactgcattaaaaaagcattgcctgaatcctagcataccgtaaattaatgaaaaatacagtcccactatttaacttagataaaatttaacaaaaaaacgcgatcaggccgattaaattatcggtcctaaccccgttattttaccacattctgttacgaatccgtattacaatttaacacgccctgctcggcaaaactgaagtaatcgtttacaccgataataaagctatccaagagtggtaaccccatcagttcacaagccagttgcaatcgcttggtaaattcaatatcttttttagacggcgtcacgtcaccgctcggatgattatgggcaataacgacccgggcagtcggcgttgtcagggcaaccttaataatttcccgcggttgtgccgggcagctattgagcgtgccctgaaagacgacctggcgtttgatcacttgattcttcgtatctaagcataacaattgcaactgttcctgctctaagttggcaaagtcccgtgctaaaacggctcccagttgttcactaccatatacctgtcccaatattaatcgacttggccggggtagtaattggccacatctgagtgccacgatcaggccatgccacagcggattttcagacgactcgtgtaaccattcaacggcgtcctcaatcgggtactcacgttcaaaagcatgcgtggcgctatccacctcgtcgccaggtaaaaacgtggcaaaataggcctgcagtaattcacgaacttgtgtagtcggtatttgttcctcgctaatcatcgtcattgaaaccaccctttctaccaagtagtttcgcaaaatgatcgcgtcaccattattttgccgcaactttttttcaaattgaacgctagcacgcacctgtgacctggtatgatcgctgtcagtcggacgtcactaccatacgaatgactaagccgtcgtggaatcgctaccgtccttgaaataggcccgaacatcactaataaagtacagcgaccccgtgagtaacaacgcatcatcactcgacatctcttgaagagtctgcatcaaggctgcttgccaattatcaaatacttcagcggtccggccgttcggcatttcctgtgccaacatcgccgggtcggtcgctggacgttttgcgttcggaccttcgaattgtgtcaaccgtaattgaacattgggtaatgcgcccaaggtctgaatcatttgttgatgttgcttatccgctaagaccgcaaagatgacgtagacggtctgttgcccaaaacgctcgcttaaagtcgtcgctaattcggttactgccggctcgttgtgtgcaccgtcaatcataatcagcggatcctgattcaagcgttcgaaacggccaggccactgcgtcttagccagagccgttttgacgtcgctagtgaccacgggtagctgcaatccttggtgataagtcaagtaagccgctaacgctacggccgcattatcaacttgatagtctcccagtagcggggttgtcaagtccttaaagtgcgcctctaacccgtcaaagttgaaccgttcttgccagccttggggcggtaataatttggttgtaaaatcaattcccaacgtccgcaacggcgctcgtttactgtttgccgtatcgaccatcacttgctgggcttcagccggtaatttaccgacgactactggcacctgatccttaatgatacctgctttttgagtggcaatcgccgtcaacgtattcccaagaatttgcatgtgatcataaccgatcgtcgtaatcacactaacggccggtgtccagacgttggtcgaatcgtataacccacccaacccaacttcaataatggcaatatcgattggctgagcagcaaagtaaagaaacatcattacggtaatgatctcaaattctgtgggccccccacttgccaatgtcgcatcaagcttggcaacgaccggttgaatctgttgcaccaggccaacgagttcttcatcgctgatgggggtgccgtcaacactgatccgttcattgaagcgaacaatgaacggcgacgtgaaagttcccaccgttagcccatctgccataaataattcgcgtaaattcgcaaccgtcgaccccttaccattggtgcccgccacgtgaatgccggccacctttaactgtggatcacccaattcatgtaagaattggcgcatccgactgagtgtcggggcttttttgaactgagtccggccgtgaataaaggctaatgctgctgaataagtgtcaatcatgttggtcttccttcctgtaaaccgcgcgaattatcatttggccgtttgctcaccatacttctagctaatgagcccttatattttacgttttaataataaaatggtaaccatcccaaaacgggacgattaccattttaccagtaacacacatttcagttaactattatcgcaaattaagcttcagccttaatatcaactaaacgttgctttaaggcagctagttttgtctgattgtccgctaacttctctttttcactattaacgacgtcttcaggggcattggcaacaaagcgttcgttacctaacttcttcgtcgcccgtgcgacttcgctttcaaacttggcttgttctttttcaagttttttgacttcttcatcgaggtcaacaagttcagctaacggaatgtaaacttccgcatcactaatcacttgtgtcatggctaacttcggtgcaaccacgtcggcgccaattgacagtgtcttcggatgtgcaaaccgttgaatataatcttcattagccttgaaaacggcttgtaaccgagtgttgtccgtcttaattaatagatccacggctgatgacatcttcgcattagcttctgctcgaatgctccgaacggccgtaatcaattcaataagtgaggccatatcactttccgccgtttcgtcatcaaattcaggatggtcaacaggataagcagcgactactaaggattcaccaacgtgtggcattgataaccaaatcttttcggtcacaaatggcatgattgggtgcaataaccgtaagatctggtccaagacataggctaacacgttttgcgtattggccttagcttgggcgtcatcaccggtcaagacttccttactcatttcgatataccagtcacagaagtcattccagataaagttgtacaaggctcgaccagcttcaccaaagtcaaacttatcaaaggtagtcgtcacttgtttaaccgttgcgttcaaacgactcaagatccacttatctgctaacgtccagtcacttgcagctggtaattccggtttgtccatggtgcccaggttcatgataacgtagcggctggcgttccaaatcttgttaataaagttccacgccgcatccatcttcgtatagctgaaccgcacatcttggccggccgtcgacccgttagataagaaccaccgtaaggcatcggccccgtacttttcaatcacatccattggatcgattccgttaccgagcgatttgctcattttgcgaccctgttcatcacgaattaagccgtgtaaaagcacgtgtttgaatggccgtttgccagtaaattccaaactctggaacatcatccgtgatacccagaagaagataatgtcgtagccggtaaccagcgtatccgttgggaagtaacgcttaaagtcttccgcatcagtgtctggccagcccatcgttgaaaatggccagagtgcacttgagaaccaagtgtccaacacgtcgggatcctgttcccagttttctggatcttttggtccatcaacaccgacatacgtttcgccggtcgtcttgttataccaagctggaatccgatgtccccaccagagttggcgtgagatcacccaatcgtggacgttctccatccattgattgaatgtgtcttcaaaccgatcaggcacaaattctactttattgtcagtcttttgattcttcaacgcttgctcagctagtggcttcatcttaacaaaccactgggttgagagccgtgcttcaacctgaacgccggtccgttcagaatgcccaacgctatgcacgattgggtcgattttaatcatcaaatcttgatcttcaaggtccttgaccatcgctttacgcgcttcaaagcggtccataccttcgtatttacccgcattggcattcattgaggcatcatcattcatggtgttaatccgtttcaaatcatgccggttgccgaccttaaagtcattcgggtcatgggcaggcgtaatcttcaccatcccagtcccaaactcgggatcaacatacgcatcagcgataattggaatttcacgttctgctaatggcaagatgacttttttgccaaccaattccttgtaacggtcatcactcggattaaccgcaacggcggtatcgcccatcatggtttcgggacgggtcgtggcaatttcaatgtaatgcttaccattgaaagtatagtctttgtcagcaaatggatacttgacgtggtagaacgcacccttgtcatccttatggatcacttcgatatcagacaaagctgtccgtgcttgcggatcccagttgatgatatattcaccacgatagatcaagcccttgttgtaaagatcaacgaagactttcttaaccgcatctgacagaccatcatccatggtgaaccgttcacgagaatagtccaatgacagtcccatcttggcccactgttgtttgatgatcgacgcgtattcgtctttccaatcccaaacttgttgaatgaacttctcacgaccaagatcgtaacgactgatcccttgctcacgcagcttggcttcaacttttgcctgcgtcgcgataccagcatggtccattcctggtaaccataaagtatcaaaaccttgcatccgtttttgacgaataataatgtcttgtaacgtggtgtcccaagcgtggcctaaatgcaacttacccgtaacatttggcggtggaatcacgattgaatagggtttagctttcttgtcgcccgaaggcttaaataaatcttggtctaaccaagtctgataacgacccgcttccacggcggtcggatcatacttagttggcatatcagtagttggttcttctgacattggggcacatcctttcttttggcactaaaaaagtccactcatcctattagactaggacgaatggacttcgcggtaccacctaattttaaagccatcacaagtgatcgctttacagcttaaacatcgttgttaacgaacggtgtatcccgtccggctattcctactaaaacagttcagaatagcagctcgcaagctaccttcacgctaaaaacgccaagcgtgtttcactgttcacgctctctctgttgacgttgtttatcgctactctcttgctcattgctggttgtcactattgtaatgaatttcctgagtgccgtcaatccttattcgaattgttttaaggcatccagtgccgcaacgtaatttggttcatggctaacatccggcacgatttcatgatacacgattttaccagttgcgtccgcgacataaattgcccgggtcaacgttccgttgttaggcaagtagagattcgtggcgtaaccaaaggataattcttcatcagaagccaccgttaagttcttaacgccttccttagcgcaccagccggcttggtcggcaaccgcgttattagaaatggctagaaattgaacgtgggggtacttatcagcctgttgattgaacttcttcgtttgaatagaacaaactcgcgtatcaatatctggcatcacacttaacaggacgggcttgcctaataagtccttagtcttaatcttctcatcatgggtagtgaacactttgaacttcggtaactggtcaccatcttgtaacggttcaccgactaagtctaacgcttgatcatgaaataatacttgcacgtaaaacaccccttcgataactaatggttttctaatatttgtggtagtactagtatagctcaaatttaacgcaatttcagtttccgcgcaaataatcgtctcacaaattatcattctttacatatggcgcctgatttagtgttaatcatggttcaaacgtgcgcatgagttggttccttgttcatcagctgggtatgtcctaccccgacctccgtgacacttcaacacgtgtgtactatgttaaagcatcaatttgtggtgtcgtcgccagctggagagcgagttgtgttgcccgttcgagcgagccatttgtttgttgttcccagcgcgcggcgagtgtgttggccgggtcgtgtagactagttaagatatattgggcaacttgtgaggcggatggttgacgtaagctggtggccatagtttgtagcgcctcagctagttgtttgccttcagttagctgccggggcacttgcatgggggcttcgatagcaacttgttcgttggcgcgctgccctgcctcaacccaactatccacactagttggcactggcaaccagatcatcagtaggacaaaccacgttaggcaggtcagttgggacagattgatgcccgcagcggcccatggattcaaatctaagttacgtaattccaagtattgaatcccatcctggcgtaagtgtgaatgatcaccggcatgacgcaatcgaacctgaccgtaaaattccttggtcgcgctcaattgaccactctcgacggccgctcgcagtgtttggcaatagcgttctagtgaagcgtacgaaactgttacgcctggcagattggtatatccatgagcactgttgcgtaagcttcggactggctgggatggtgccgttaagccggattgtggccaacactgcggtgaacagccgtacaaatatgtcagtaaccagcgatagtgcaagtaattctgcgcgatgtgcaaataacagcgatttttaaaagtagtgaactcatgacagtccgtctgggcgtcgtacaagcccttcatgagtccggtagtgatgctgatattgcaatgaagacctgacagcatttgacgacgccggccatagcggcgggcaagttgttggcggtaagcgacggcgttcgtatccaacttagcgattggaatatcttgttcattttgcggcaatcttggcggcatgcttagcggccaaatcagttcagggcttaagccttgccgaacttgttgtgtgagcagtgtcaatgcccgtaaaacggcctgcgaacctacttgtggcggagtgactaactccagctgtgtctccgcaaagtcccgttgtaggccgggcaacttgctgatgagtaccggtgataacgtcgtctctgccaagcgaccggtcgacgttacccgttggccttctcgttccaggccaatctgaatcgcctgagcatcaatcagcgctgcattcttcgttaataatcgttgccactccatccactcacctcgttgattcaatctgaatttatcgtagcatagtccgggtcttggttcgccaattatgacctattatttagctagcttatcactacgagctgggctcccacgtaccaggagctggatacaccattgaacagcatcaaaaaacgagtccccagaatgaccgggaactcgtttttcgacgtgatactatcactcatttttgacctaaagtagttcagcaaaaacgtcttcttgtgtattcaagtagttttcacctggcttgatctcggtcattttaacgcccgccaaagcacgcgccatcaatccttcaacgtcaatccgttcttcgtaggcccgggaacggtctaacttcggatgcgtcttgggtgctggcggtgcaaaaatcgtacagcagtcttcgaatggcatgattgacaagtcataggtatcaatctcttcagcaatcttaatgatttccgtcttgtccatggaaatcaccggccgcagaacaggcaacgtcgtcacgtcattgatggcaatcatgctatccatcgtctgtgaagccacttgccctaatgattcaccattaaagatggctttaccattccgttgacgcgtgattgcgtccatcaaccgcatcatcagacgccgttgaacggtcataagatacccttcagggactttttccttgatttcttcctgaatctcagtgaatggaatctgaataaacttcacgctaccggagtaactggctagcgttgatgctaactgcttagcctttgctaacgcttgttcactcgtgtatggcggactgaagaaatggaccatttccatatcaacgccacgcttcatgcccaggtagcccgccactggtgaatcgatcccaccagacaacatcagcatccctttgccggcagtgccgacgggtagtcccccggcaccttgaatcgtttctgatgataaaaagatgccgttcaaccgaacttcaacccgtaacacgatgtccggattcttcatcttaacttgaatcccgtcaacgtgatctaagatttgcccaccaagcatatcattgatttgatttgtatcgtattcaaagtgatggtcggaacgccgggtgttaattttgaaagtcattcccggttcaaactgggctttgaccatcgcaatcgccgtttcatagacggcatccatgtcggcatcgacgcgaatactaggtgagaagttttgaattccaaaaacaagtttcaaacggtccatgactttgtcggcatcctcaccatttaacatgatgtgcattcggtcacggttcgcgtggacttttaattctggaaagtcgtgcaacgctttacgtacgttacggcccaaactatcaataaagttccgccggtttttacccttggtcgatagttcaccataacgcaccatgatttcagtgtactgcatgaacaagttcctttccgttatgcgtctgcattaatttttgagaatttttgatagagctgatcaaaaactttaataaactggtcagcttctgccagcgtattattctcatcgaggctgacccgcaccgcactcgtcgcgatattttcttgcacgtgcatcgccattaaagtactagaagccaggtgcttcttcgacgagcaggcactcgttgttgagatataaatgccctgatcttcaaacgcgtggacaatggtctcgccccgcacgccgttgatcgtgaagcagagaatgtggggggcgaaccccgtcgttggctggctaaagatcgtcactttaggaaatgacttgatgtgctcgtagattcgctgtttgatagcccgttcacgagccaccttatcatcttcatctgtcagcaacaatcgcaaggccttcgccataccggcaattgctggtaagttttcagttccagaacgccagttactttcctgaccgccaccattcattaatggcgccaacttgcgaccattacgcgcgtaaataaagccaacgccgcgagtcgcatgaaacttgtgccctgagaaggtcacaaaatccacccggtcattcatgatcatgctctggatccctttaccaattccttggaccgcatcgatatgaaaatgaattttcggatattgtttcagtagttcagccacttcaagtaagggttgaatcgtaccgatttcattattgaccgccatcgttgacactaagatcgtatcaggccgaattgccgctttcaagtccgccacgttgatgcggccttcctgatcgactggtaagtaagtcacttcataaccgagttccttcaactgttccatcgaattatgaattgccggatgttctaccgccgtggtaattaggtgtttcccaaaggaccgcttttcaatcgccgtcccctttaaaacccaattgtcaccttccgtcccaccagacgtgaagaagatttcatgcgcttgcacaccgagcaagtcagcaatttgttggcgcgactgttccaacaaatgaaaggccgtttcaccaaagttatgcaaactggatggattcccccagattttctgggaaaccgttgtatacgtctccaacacggccggagcagcttgcgtcgtcgcactattgtcaaaataaatcattactacgccttctctttccaagaaagtgtgcattgcacttactttcgataagaattctttgcaattataccaaatattactagtgaaacaaggttttttgtttcaaattaaggattaactacccgactattgcggcccaaacttgttttcagtgctcatttccagttccgtgcgctcacgatcactggcatcctgataccaatcaaaaaccagccggtggcggttgtcatttaacaatcaccaccagctggttattttcaattcgctaagtttggcgtgttgacgcagacttaattgtcattaagcctcgtcagtcgtcttttctgcttgtttattcgcataatagctgtcctcaattcgtttataggatcccggatcgactttatcgactgctgtcgcaatcacttctaaactccgtgcgtagtcgtgcgtttcagtaaacaaccgttgtgcttcgacgctagcttcctgaacctcttcatgattcgtcttgtaacggttggcgtattgcaagagctgttccgccataaccgcagcatccgttaaatcactggtcttctccttcaaggtcgccatgtccgcttgaatgacaatcaattgtttcgtgatgtcatccatattgatcacgagcttattaatatcatggtcaagccgttcgatctccttggcaaccactttgaaatagtccaagtagtccttcggtaggcccggcaaattcaagttttcaacctggcgcttgattgcgtgaatctcaaagtcgaaccgttgcaacgtctcgtgagctttagattcctcagcggtcaaactcgccacgcctttgttgattgcaacctgttcttcttcaatgccttttaactgctcatcttgttcggcaaaatgggcggcaatctcactaaagacagcttgcttactagtaatggccgtgacgtccgcctgataaacagcttcgatattcttcaattgttcgttcagttcacgcgtccgttcgacttcgccattattcaacgtatagctctgtgctaatcgatccaactcaatttgtaagcggtgattctgattcatggcgtgagtcaagaacttgctaatttcttcttggcgttcgtcaacgacagccttcgcatcgatttcaacttgcatcacgtcatacaagtggtcgattcgcttctcaattgcatgattaccgttttcagcatccgtaacttttaaatcacccagtaacgccgtattatcatcgattgccttttgtaacgccttaatttcaggttcaatcgactcgacttcaaagtgaaaatgttgcgccgtcaattgttgataaccacttgccaattcggccagctgatcagggaacccactcacaagatccttatagattggtggaattcggtcaatgtccatttcaagcgtcccggtatcgtgatgcaactgatctagcactttttcagcagcgtcatgatcgccggccttagctaattcagaaaaatgatcgaagtcactttctaagttggccaattgatcctccaacttgtcaatacttggaccaaacgaaaagttttgggacaataacgtcttccgtaagttttggtactttttctctaaacttgccactgcttggcggtgcgcggcatccgcatcatccaaggcctgtagcccctgacgaatttctgactgttgttgttcgatcgtatctaatgtcgccgcaacttttttcaggttctgctgagcatcgagaaatctgatgccccgcgcctgcgaagtaatggccgttaattgctcactaacggcgggtaactgattattatcaacttcttgaccagcgctctgcaacgcttccaacttcgctaacgatccgcccgttagtccgagttgttcaattttttcgaaatctgtggtctgcgattgcttgactagcgcctgttgccgttccgtcaattgacggacttgcttgtcgatataaaattgaaagcctttgaccgccgcgtagatgacaatcgcaaccaccacaatgccgattgctacttgcatacgaataccccttacattatttattccgttttaattgcgttgcgcctcaccctgttgagaaccgtaaccttgcttttttctgaaaatccaattaaaatctatcttaaattataacatagacgtaactaacggacagtaacaatttgttaacattcaaggaggatttttacatggctaccacggaaacatcacttatgaaccaacaactcgacgccctactttttcaagaaacgaatctggtcgcgaacttagcgaatgcaagcgccctcctcaacagtacttatgacaaccttaactgggccggcttttacttatttaacgaacaaactggcgagctcgacttaggccccttccagggtaaagtcgcttgcatgcacatcaaggttggggccggtgtcgtcggaactgcctttgaaacgcaaacaaaccaacgggtagctgatgtccatcaatttcccgggcacattgcgtgtgacagtgccagcaactcagaaatcgtggtgcccatcaccaaggacggtcaccaaatcggcgtactcgatgtcgattcgccatcattagatcggttcaatgccgataacgaagccgaattaactgaattcgtggcaatcctcacgtcacacattgactaatcagcattaaacgtgttatgctactctttgtgtaaaataatgcagcagtgagtgggtaagctcgtcaacagattggtgccaatattttggtcagttagtaacctgcggctgcaatggtgaaatctgcagtccaatctgaacgaatatcgaacttacatcggattattttactccaactaaaattattggaggaaacattttatgtctcgttatacaggtccaagttggaaaatttcccgtcgtttgggaatgtccctttcaggtactggtaaagaattagctcgtcgcccttacgcacctggtgatcatggccaaggtcgtcgcggtaagctttctgaatacggtacacaattacgtgaaaagcaaaagttacggatgatgtacggtttaactgaacgtcaattcgctaacttattcatcaaagctggtaagattcgcgaaggtaagcatggtgttaacttcatgatcttacttgaacgtcgtttggataacatggtttaccgtttaggcttagctacaactcgtcgccaagctcgtcaattagtaaaccatggtcacatcactgttgatggcaagcgtgttgacatcccttcatacgaagttagtgttggccaagttgtctcagttcgtgaaaagtccaagaagttagctgttatcaccggtgctgttgaagccgttgttgcacgccctaacttcgttcaattcgatgctgataagcttgaaggctcattaactcgtttaccagaacgtgaagaacttgaagcagatatcgacgaatcattaatcgttgaatactacaacaaactttaatttccggtatttaaaaaaccgtcgcacttgcggcggtttttttgtgttttcagttaaccttagtcctcatgcgcagcactcacagccgccatgaccggttgatagattggtagtaactgtttgaacgttgtgatgatcaattggttcagcgcgtcggcatcttcaaataacggatcgttcactccgactgcacggcccacgaccaattcactgtgtttatactgatcgaatttcttgatagcctgcgtaatattggctggtgtagcggattccgtggtcggcaccccatgattgttgctgataacaaatcccgtcggcaaggccagtaaccggggcgccaaatctgcgagttgcatctgtgcctgcacggccggtttacactcatctagaatatcaaaataaataaataaacgatctggccatagtcccaattcaaagtgcggccaggctttataactccgtttgttctgactaaaagcgacccatgtgtctaccggtggattcttaaagcgccgcaaatgtttggcaacgtgcgcataaaacggcggctcgccgggtgtttgtaaattcgctataatcgtgggtgcaagctgttcgaacttaggatcaatcaccgttttgatcagatgcatgcgccccgctaacgtctggtcattaaaaatgtcaaaatcttgatttgtaaacacgtctatcatccccaaaactaatttagattaaccataccgcattcactaacgcaacgctagcccccttcccttcgctattattgaaggaacatgctacaatgataattactatcaaggaaaggatgttagacaatggctgaaacagacaaacaaccagttgaccgcatcgaaacggccatgcacgggacgccaaagttgcatcccgacgaacagcgcaagtacctggggacctttcgggaacgcgtcgaagtcgcagtgaccgttgcccaaattaagcaggccaattacgtcgacgcacttaaccaagcatttacgacccatccggatgatcaattatacattaacggtaatctagaccaggaattgattggcccatacatcaaggcggctagtcaggccaatatcaaatttaccattaagacggatgacatctaccatactgctgatgataattacgcgctcgtcttcactgccgcaactgccattaaccaagacgttattgacgtggcgcagcgctacccatcgcagtcatcgccagcaacacccaaggcggaaaagacgcccggactgctagataaattcaaaaaattactttaatacaacgaaggtcctcatccacgtacggatgaggacctttgttacgttgaactgcactaatgatgacgagccagggcaccataaaaactcaggatcaatagccccacaacaatgattcccatgagaccgactgaaacccagacggtcgtgacgatgctcagtaatagcaatacgccaccaccaaccaacgtatagcctagccaataacggacccgccgccaaatcattggtcgaatcggatgaccaccccggtgaatctgcgcgtactgattggcactgattgtcggcaaataatttccaatcgccataaaaataaaggcaatcaaactgacggcgatgcgccaaatatcccagtgatggcctaagttataactgatgtttgttgcatagatcacgcctgatagcacgggcacgatccaaatcatcatctgttcaaaccgtggcgccggtcccttatgattggcgttcaaccgggtcacacccacacaaatcagctgaaacaccatcatcatgattggaaagccaacaaccactagcgctttggtagccatcccattcggttgattatccaaattaaaatgaatggccattttggcaggcaacgcggcgtaattcacaataccgtagccgattggtaacagaatgacaatgtaactcaaccacaattgaagatttcgttttgtcatcattattcatccccctgctgtgaactgaagcgatatagccacgtcaacatttcctcaaacacactagcatttaactcatagtacacataattcttttccttagttaccgtaaccaagccggcttccttcaaaagcttgaggtgataagaaaccgttgccttgcttaacttaaaatgagctgcaatctcgccagccgattgccgattctggcgtaaatcttccaaaatctgccggcggacgggatcagcaatggctttaaaagtcgtattcaacgccatgcgggcaccccccatcagctatttcgatatatatctaaatagattatagcaggtaagttgcacttcaacaagaggtatttagatgaaattcgaaatataacaatccagcactttactcatacgcaaataaaaaacgctggccaaaaccagcgtttttttagtcttcccctttaaacaacgcatccaacaactgccccgccactggttgggccgtgccaaacattgggaacaagtgcggatacaagtatggtgctgcgtgaatacccaagtataccgccatttctggatgctctggaactaattctgcgtataaattgggaatcatgacgtcgacccctgcgactgctaagtgcaagtctgcaaccaacttttccaccgcctcaacgtaggattgatgcatgtcggccgtcgcgtctaacacatccgccccgttaccaaaagtggcatcttcccgcaacaagatctgggtgccccggctgaccacagaatccaagttcaggtgatatgaatccaggcgataccgttcaatcgttcctaactgtagcgcggattgaggccacttaaaggcggttcctcgcaacgctcgctcatttttgcggtcaagtaacgtctggaccgttgaacggccatcaccaacaatgttggccggaattcgttcgacgattgcttgcacccgaccatcgatgaccaagaatcgataacttgaggcgactaccacttcttcagccatcaccgcggacgtttgctcgaatagttgccgaacaacttgttcgaacaagtcgcgttctggcataatccggaaaaccacgactttatgcgtttcatccgcagctttcaacacgattccgccggcttgaacgtaccgatcgtaatcagcaatcaactgattagccgtatgatatgtctgtgaagccggcaccggaaccccgtgctcagcgagaatttgtttggccgctgctttatgtgtcagtacagtcgttagcgcttgtggatttaaatccgttccgctaccattgacaactaattgcgagcgccctaacttagtcaatcgcaaaatattagcgtgtggatcaaccacgtccacctgcacgccccgcgtcaaggcctgctgggctagttgctggctcgataaatctagcgcagtaaagcctgcaagttcaaacggccgttcattgctcgattcctgataatgggcagccgttttgagtgcccatgccaccgggtcagcttgcatggcaattttggcgcttagcgtcgtcttcggatcagtgacccgcgacttcaacgttcggagtaacacggcatcctcgtttggcaagtgataagttttaacgaaatcagcaagtgcatccaacacttgagcagccggtattgcctgagcactagccgtcgttggattttcagccaagacttggcgcgtcagttggtctgcttgcgcgttgacctgagcgaccatcttagttgggagcgccggcatcatgacgaaataactcgccaacaaacgaacaaaagctaccgcgttggcgtccaccccaactggactagttgggtcaaggtccaagccccggtattcaagataatagaccccttgccgggccattgtggctagctgaccgttactgcgaaaccgaacgggaccatcaaaatcattgaccgacaacagctgcttttgacgaacggccgccgtcaatttagcgacgtagcgatcaatcgacgtataatctcccgttacttgattgtagcggccatcgggatgctgcacactactgcgttgcggacgacgctcagtatccgtaacggctaggcgtggtgaagcaccaaataaatactggatcaaccagttcatccggaccagcccctgggcaactttcaagtagatggcgttgcgaaaatcaacgtaactatgatattgctgatggaagacctcagcatataaccggatgaataacgcttcgttcaagctgagattcacgtgactaccagtcgtcaatagtcgctgcaagtcatacttacgggccaaatcgcgacgatgctgatagctgacctgatcaacatcggccagtggcacggtcgttagatcagctggcagcacaggcgtactcgacagtggccaaagtcgttcgtccgcagcgagtgcccgccgtgcagcggtattcaagcccttcagatacgccatcaatgccggaatgtcgcggcgcactggcgtactaaactttaaagcactcgcggaaaagcctggccgtagctgtcgattttgttgagctgatccaaacgcttgcgggtgcgctgttgtcgctaagtgcccctgggcgtccactcggtgcatggtgacctctaagcctaagttagtctgatgaacaagtgggactaagtgatactgtacaattgccttaccaacggcgtctaattccataatgatcaatcctttgtaattattctgtttgttaaactgattattcggtgtccttcattgtaaatgctataatagttgggactagttttgcaaggagggatttcaaacgatgcaacaaccattagcctaccggatgcgaccaaagacgctggaagacgttgtcggccagcaacaattggtcggcccaggtaagatcatcgcccggatggtcaaagccaaacgactatcatcaatgattctatacggcccaccaggtactggcaagactagtattgcgagtgccattgccggttcgaccaagtacgcttttcgcatgctgaacgcggccactgatagcaagaagcaactccaaatcgtagctgaagaagccaaaatgagcgggacggtcattctcctactagacgaaattcaccggttggataaaacgaaacaagattttttattacctcacctagaaagtggccgtatcatcttgattggtgccacgaccgaaaatccatacattagcattaatccggccatccgcagtcggacgcagatctttcaggtttttccgctcacagctgatgatattcagcacgcggttgaacgggcgctcactgatgaccaaaacggtcttggtcagtaccacgttgagttagcccccgcggccatgcaccatctatgcactgcaaccaacggtgatttgcgtagcgccctcaatgggctagaattggccgtgttgtcctcgacccccgctgatgacggtactatcgccatttcacagcaaacgattgaagaatgtttgcaaaagaaagccttatccgcagataaagatggtgacgcccactacgacgtgatctcggcctttcaaaagtccatacgcggttccgacgtaaacgctgcattacactacttagcccggttagttgaggcgggggatttaaagagtattatgcgccggctgatggtgattgcctatgaggatattggattagctaatccagccgcgtgtgcccacaccgtcgcagctgttcaagctgccgatcaattgggatttcctgaagcacggattccgctagctgacgctgtgatcgaattagccttatcgccaaagtcaaattcagggatcagtgccattgatgctgcgctcacaacggtccgtgacggccatttcggtgatattccggccgacatcaaggatgcgcattatcaaggcgctgccaaactcggtcatggtgttggatacgattttccacacgatcacccgggtgattgggtcgctcaacagtatttaccagatgccatcaaatcagctaagtattacgagcccaaaacaaatggccgctacgaaacagccctggcgcaacaatacgaaaaattattaaaagctaacgcacgaaaccgctaacaacaccttggttgtgcttataattgcaacttttatttttatatgctagactaagagtcgaaattactaaggtgtgcgcattgctctaaacaaagtgttgccgaacaattaatactactttgggatgtccgttagctaattccataacatgccttatcctttggtagttagcgagttagtcagaacgtcccacctgccttaaagcgggtcaatactgaagggcgattaacggcaccactagtttttccggaagtttacttccgttggtcaggacttgttcctggccttttttgatggcgtaaaaagcgcccgagttggcccccctactttatcaacaccgcacaagccccaataagtaaccacgatcaactggaaggctgactatctgcagacacctgtccttaatcctggccactaggttctctggctgaatcggtctcacgacacttcgccacgttgcacaggtctgcgtctcgcgaaaccagtccgatgcgtctcgcaattattttacgctaaatcgacgttgcgcgcgctcaacatcctaatcgctgatatttattagcattgcatttgtcttctcttctagaatcgactaaaataagaccatcatcaccgtttggaggttcattttgattacactactgctcgtcatatacacgctcattgcgggctggctcagttactatctgctgacccaccagtcgcgcccatttctcttttttgacccgaacaaggcgccgacaatcaaacacgtcgcacgttacggtggcagcttaatgttactagtcacaattgcctgtttcgtgacgatctttgttcaagcaaccatgctaattgccatcgtactagctagtggttcactcattatgatggcaattgccctaattttagtgagtttcatgcaaatctcgtagaaaacgctttttattttttgcgaaaacctttacaatatagttataaagtaatgaggggtgagaatgatgttacaacaataccaacacattttagttcctgttgatggttcttatgaagcggaattagcatttaaaaaggcggttgccgtcgcgaaacggaacgggcctaacgcctctgttcacatggtgcacgtggttgatacccgcgccttccaaaacatctctagttttgacacgaccatggtcgaacaagtcaccgatactgctcaaaagacgttggacaagtacgttgcagaagctaaggcggacggcttagataacgtggactattcgattgaatatggcgcgcctaagacgattattgcgcgtgacgttcctaaggacatgggcatcgatttaattatgattggggccactggtctcaatgcggttgaacgcctattaatcgggtcagtcaccgaatacgttactcggatggcggtttgtgacgttctcgttgtccggactgacttggaaaacaagccggcaccaaaaccaaagaaaaagtaaggcttattatacgtaccagaaaaaatcggctcagtgaagttgtttgctcacctcactggccgattttttgtcgctaattttcacagtcagaatatttactgctccaatatcgcgcggtacaacacctgaccaagatcattcatcgcactagtttgcgccgtccgctccccactggcagccatcatcgtcatgataaaggtcccctgacgattccgaacaatcgccgcgtcattttggacgccataggcttgatagtccccagttttgttatagatggtcgcacgtgttggcagatttttgaccaacttactgtgatccgtattcgccttcagaatcgttaacatcgcgtgatcggccttattcgagatcaagcgccggttggccagtcgtttcagcaccgtggccacatcccgaactgaagtatcgttatcatgaccggcccttagtgcggcagtatccattaaccgccgcgccatcctggtatccgttagacctaactgcgcaatttccgtattgaccgccgagaagccaccgacacgatccaacatgatattagcagccgtattatcactctccgtaatcatacgttttgtgatttcagcatacgtcaactggctcccagctggcaacgtgtgtaacgtcccggtcccaccgaccttgtcggcagcacgcagcgtatagcggtcctgcatgcgccagttattttgctgaacctgatcataagcggtgaccatgataaagagtgtgatcaaactacctgcacgttgcgcgcgattgttcacaacgacgccctgactacctgccagtggcattaccgctaccgaagtttgtccagctaatccgttcgttgcttgcccaattaggtcagtgaccgttgcggccggaaacgccgacttagccggctgctgggcgcttgaatcattatctgctgactgaggggccgaacttttccttgacgattcggccgtcgccggtgtcgtggctgaccacaatagtcgccccacgatatagccgccacctagcaatagtagtcctgccaccaggaccccaaggagcggtcgccgactgaatcgacttgaaaaacctgtccgccgtgattgtcttcgacgccgttggacccgactttgcaaattagcatcaccacttgattgcactaaccggtgaccacattttaggcaagtcacggtctgcggcggattatggtaaccacagttttgacagctcatctttcatccccccggtatcaaaaatgggacagtcaacgatgtaccgtgcttaagcgggccctttcacccactaagcgcggccattcaccgctaactgtcccatcacgtcatctaagcttcgttggccacttgcaagggtgcaatgtggtactccgccatttctttcgtgattttttcggtcaaactattgttatgggtcaccaaacttaacgcgtaggccacgtaatagtggtcatgtgctgactggacattgtttaagacaacttcattggccgccttttgcgcgtacaagcggtccaataaataaagggactgactttcctgcgctttcttgagtgccagatcaatcaattccaaagcttcctctgggaaattgatcttagcatacaattgtgcagccgaagcgtagatcaagatttcgttttgcaaataatcgtcgtcacccattggcattgcttgtgcgtccatcgtgtgtaaggtcgcgaccgcctgcttgacgaaaatctcagccttatcataggcttgcttacgttcataggctaagccagttccgagtgtcgccaagatggcaaacatatcgtgactggacttaacgaactgattgagcaacaacccaaagttaaagatggcttcgtcagcattgtcattgagtactaactgaaggtacccctcatagtagtaatactgcttcttatctgtattactacgtaactgcttcggccggatatgttggaacacctcttgggcctcttccagttgcgtatgtcgaatcaaagtatcaatctttttgaaagtccgatataactggtcatcattttcaataatgacttctgacaaacgaattcctaatcgattacagattttcatcataatcttcatacttggaattttactctttttctcaatcaaactaatcgttgcctgcgtacaaatcccatcagccagttccttctgcgacatgcccttccgctttctgaactgccgcactttttcacctaatattctcatgtttaacccctcttcgttgattgccgtaaaccaaactcattttgtaactacccttgctgcccccactcaatgaacaagggtatcgtgacacctaatcaatcctcattaatacgttcgaataattgagcactaaccaattggacaataccaatcacgcatataattatattcacataacggaattttagcaagaaatacgcgtaattcttatttaatattaagtttataccatgatactggcccaaggtcatttattaattatccagtattccagttcgttaaccaccctaatcaagagcttgttcattaaaagtgagaactactgaaagcgatttaaaggggaacgaattagctttatcaacggccattatcaattgtcatgacaccctcaactaattgattgacactacttaataattaagactgattctcatacttctttcagtagtttataaccaactaactagccaatttatcaattgataaaaatagtaatgctgcggttggtccagtaatttgccgagttgtcctggtcggttcgtaatcagcccgtcagctcccatagccgtcagtcggtgcatcgctaatggccgatcaacggtccagaagtagacggcctgatgctgccgatgcgccgcgctgatctgttcacgggtcgcagtcagggcttgcagtgaataaaaactggcaacggaatcagaaaagtctgtcagataaaacggcgttatgaacccaactggcaattgggccgtccgttgatgcaggcgctcaattacccgataatccaaggagtgcaccgcccctttttgtcggatcaactgttgcgcatagttgtcagcaaacggccccatgagctgatcagcagctccgaccgatttgatttcgactaataacggttgctgtaacttgttcgccactgcaaagtactgcttaaacgtgctcaagtagcctttctgaccatgctcccgtagcggtaatccgctcagtttgtcgacggggtactcatgaacggggccgggttgacccgccaaggctttcagcgtcggatcatgcatcacgacccagtggtgatctgctgtcaattgaatatccatctcgaccatatccagccgaacttgcttgacagtccgtctaagcgcttctgtggtattctggacgccatctcgaccatttacaccccgatgtgcaataatcgctacgggtgccactggtggcgttcctagccaccagcctgcgtaaccaccgaagattagcaaactggccgctgtcagtaccccagtttgccagttagaacgggccacaattgccgtttccggccagcggcgcgaccaccaacccatgagtcccaaccaagcaaacagctgtaaccaaatcatcatgcaaacggcgacgagtcggctgagtagttggctgacagtaccactgacccacacgatgccaataccaacgattgccatgacaagccagctaatcaggaacagccagacattgcggctttgcttaacaaccatccaccaagaagtccgccaacccgttcgccaatacttgtgccaactcgctggtcctaacaactgttgttggagtgcgggtaaccacttccagctaactagccagcccagtaaccaaagtggtgccaacagcggaagccaatcataacgcgtattaaaaaccacattttgaacggtcgccggtaattgcaggctcgcttgtaacgttgctaagtaaccgaaccaaccgagtggtagccaccatagcgccgtccccagcaacaacgaccagcggcaccaaaattggctagcctgccaccgttcgtgattactgcgggcgaccatggccggtaaccaagcgctcagaagcaacatgcctagcaggctgacgacaccgccgacctgaattccgagcactttgactaatactgctagtaacatgcccgtcacccaccagtgggctaacggtcctaccagctggcgcgtaccctgcgtcacgagctcccatccgcgacttaacaacctgacccctcctcacaaaaaaatggcggccgtgatgaatcgcttcatcccaaccaccacaaaactcattacggtattattctgcgtccaacgcgacgaaatcatagtgaatgccagactgacgtttgaattcatcaaagccaagctggatcaactgatcgatcaacgccgtgtaactaatgccagaaacttcccataactttggatataaactaatgttagtaaaaccaggtaacgtattgatttcacccaagtatggttcaccgtcttcagaaactaagaagtcgacacgtgccattccctttaaaccaagtgctttgaacgcatctaatgacatctgctgaatctgtttcgtcaaatcagctggtaattcaactggtaattcgaacgtgaccccactggcatccacgaacttattattgtaatcgtagaacgtatccgtcttcggcacatcaatggccccaagtttagatgccttaggattttcattacctaagattgagcattccacttcacgcggattgtcaattgattcttcaactaagatcttgtagtcatacttgaacgcgtcagccaagccatccaaatattcttgttcattctcggccttatggatcccaatcgatgacccctgattggcaggcttaatgaataaatgatcacccacgtgggcttgcaaataagcgtacgtcatttgctctcgattttccggtgtgaccaccacatacttggtgttttgaatatgatgatgcgttaaaatctgctttgtaatgtccttatcaaaactagccgcggacgctaagacgccactaccaacatacggcttcttcaataacttgaacagcccttgtaaggtaccgtcttcccccaagttaccatgaaccactgggtaaaagatatcaatatccttggccagtgtcaggttcttgatgggtgctaatggatcactcatgtccaacttgggcatttcttcagcgacgacttgatcttctggttcaccatcaaatacgcgtcgcgttgcagcatcactcaggacgattccgttcttcgtgattaaaaacaagtcaatctcgtacttattcttgtccatggcatcataaatgttgtgcgcggaacgcttcgaaacgtcatgttctgaagagttaccgccaaacaacataccaacatggatctttttttgtgtctccataattttgttcatcctatcaaggtttatttcatactacggcttagttaattctacaatatctgagcacaattgaaaacatttttgcaataaaacgtgggcttttacgcatcaaacggtgcggtcaagacaatcttacctaacatttggcccgtttccacaatttcgtgggctgttcgtaagttagccgcgttaattccggccaaagttcgcttggtcgtcggtacgatcaccccggcgtcggccagttgcgcgacccgtgccagaataaccccctgcgttgccatcgctggtaactggtagttggccttggtaaacatgaactcccaagcaaaattcaaactcttcggcttgagtagcgccattggtaagggttgctgattcgtcaccacggcaacaatcgtgccaagcggccgaattaatggcgtcactaatggcaagtattgatccgttgagtgtaatagtatcacatgatcaacggactccaagccggccgcggctaattgtgaccccaaatcttgatgataatctaaaacaatgtcagcacctagctgcttgacccattcagtggtcgctggcttgccggtcgtcgtcaccacttgaagtcccgcccactttgccagctgaatcgccatcgagccaacaccaccagcaccgttgatgataaggacgctttgaccaagattcgcgtcagccgccgcagtgaatggtaacttttcaaacaaggcttcccaagccgtcagcgtagttaatggcagaccagctgcctgcgccggcgaccaagttgtcggggcacacgccactagccgttcatccaccagttgatactgagcatcactccccggccgatcaacggcaccagcataataaacgatgtcatcagtcataatcgtcgtcaccgcatcaccgactgccagaaccttagcaacggcatcaaaacctaatatgcgcggcgttgttaccggtgattgaccttgccgctgcttcgtatcgattggattgactgcagtcgccaggacggacactaaaatatcacggccgcgtggttgctcgacatcaatggtgacgtcttgtaaactattcgggtcactcactggcaatccttgcgttaatccaactgcttttgcctgcattcaaaagacttccttccaaaactaacctaaaaattctaattcatcatccaaataatcaatgacggccgttggcagatcatcgtgcaacgctaatgcttccaataatcgattgcgattgaaaatctgcgtccattcagcttcactagccggccgggtatgcatcatcaactgttgatgccagtccttcatcgcggctaacaaatagtcgcaatagagctcatgcttgttggtaatcaaagtcagataagtcgatagccgctccggttcaccgaaaattaacggcgtcgtcaatctttggtaacgcgcgatcatcgcagccaacagtaacaatttatctgcacgggcgagttgtggctcatcggccagttcatccaagatattgccaatgtgcgtgtacgcgtgcgcccagccagtcgtgcccacaaagccccgggtatccttctcgagtaaaatgtagaccgtaatttgttcaaccgccagatccagccgtgcgggcgtcataaacttaaggcccgcatggtccgcatacattaagactgaaagcagcaaaacggcaaacgagcgctggtagatagcatcattttgcggctcatcgatgtgggcaaatagcatctgatcctgaatcaactgatcaaaaatatcgcccaattgttctggtgtgagcacctgctgttgtaacgcctcgttcaacaaatagtagacaccttgatcacgaaccagtggattcaacgagccaatatgggccatcaacaacttgatctgatcgtcgctcatcgcggtcaacgtgccctttttcaactgctcatggagcgttgcaatcagcggtagcacttcttcatcacttggaatcgtaaccgtggttgtgacggtactcggtaactgttcaatcaacgttcccaaccgactgggtagcgactgatagattcgtcctgctcgaagttgctgtcttaacttcaacactgcatctttaacctgcatcaatttctctgcttgcataatgacctcgtaatctcaaatttaacttctattttagcatgtcgacgtccatctgcccaaaagaaccattcaatcataaaacgtgacctaattacgagcatgccggtaccaacttgagtcaacgcccaaatccgcaccgggccccttaattaggccacgtttcatcacgagatatctcaatcgacgcttaaagcatccctatgcttgcggcaagacatccacttgcgacttgataaacttcgctgacgccgataatgatgctcgttcgtcagtggtcaaatctagttgaattaatgattcgatgccgttcttaccaatcacagcaggcatgcccacgtatgtcccatattgtgggtcgaaggccgaaaccgggcaagccaattgggcatccgcgctgacagcttctgccaatcgaacaccacaagtcgcaatcgcaaagttggtataatgcttacccgccatgactgcaaacgccccttgccgtgcatcctcttcaagttggtcgaggttcagacctgggaaatccttgataggctgcccattgatgctaaccgttgaccaggcgacaaattgtgagttgccatgttcaccgtaaacgtatcccgccacgtttttaccattggtaccggcggcttggccgacgtacttttgcatccgggccgtgtctaagaaggtccccgtaccaaagacccgttgccgtgggaaaccggtcattcgttgtaaataatccgtcataacgtcacacggattcataatatcgattagaattcctttaaacccggacgccacaattttaggcgcaatctcccggacgatcgcttggtttaaatcatattcaccgaagcgacccttggaactattcatgtcgatggccccaatattgccggaagccacgatcaacacttcggcatctgccaaggctgaataatcatttaaaataatcttagtggttgagcttaggcgaggtgaagcgtcgtctaaatcgagtttttgcgctttggccaaggcctcattcttatcgattaaaactaattcatcaacggttccttgttgaaccaacgtataagccaccgtcgcaccgacttggcctaacccgatcacaccatatttacgcatgctgcaaactccaatctgtagtttatttaacttggttagcgtaccttgcaaccgctacaaagtcaagcaggacgctgtctcatgagattttaatcaatcgtgatttttaattgtttcagccaaatcgtttaatcagacgcgtgaagaaaccacgggaggcccatttcataaaaaagctagcttcaggggccgcccctgaaactagcttaatcaaccaatatgctgttaagaggcccgcttagtcagctgagactggcaagatagcacccttgtacttcttttcgatccattgttgcgtgctcttagaacggagcgccttcattaacttcttaatggctggcttgttcttatcgcccttacgaacggccacaatgttggcgtatggtgaatctgacttttcaagtgcgattgcatccttcttaggactcaacccagcttgaaccgcgtagttggcgttaataacgaccgcatcgccctcgttgttcttgtagaacgttggcattaacttcgcttcgtatgaatgtttaaacttcaaatgacgtttgttggtcttgatatcattgaaagttgctgaagttaacttagttcccggcttcaaggtaatcaagccggcatccttgaacaacgtcaagacccgaccatagtcagccacgttgctgctgaccagaacggttgcgccgtcctttaagtccttcaaactcttaaccttcttggagtacacgccgatcggttccaaatgcactttaccagcagaaaccaaagtaccattattttccttattccagttatccaagaatgggatgtgttggaagtagttggcatctaattctttagaagccaacgctttgttaggtaagacgtaatcttggaagactttgatcttcaagttaacgccttccttttttaattctggttggacgtgcttcaagacttgggcgtgtggcactgaagaagcacccactgtaatggtcgtagtcttggtcgctgatgatgacttcccacaaccaactaataagaatgccgttgccgcaactgctaataaccctagaattcccttttttttcataattccgtttcctcctatacgaactttaattaactcgtttatcgatatgccgaaccgcgatatccccgatgaattggaagataaacacgatgatcacaatgattaccgtcgccactaatgtgatggcattgttattggactggaaaccatcttgataggccaagttacccaggccaccggcaccaatggcccccgccatcgcggtgtaaccaattaatgaaatcgtcgtcaccgtaatcccggaaactagtgctggcatactctctggcaataacactttccgaataatctgccagcgagtcgcacccattgattcagcagcctcaatcaccccgtgatccaattcgtgaaaggccaattccaccatccgcgcatagaacggcgcagcggaaatgatcaatgatggcaaggccgcacgtggtccgatgatcgttccaaccagcttagacgttaccggcaataatagcacgatcaaaataatgaagggaatcgaccggaaaacgttcacgaacagcgctacgatccaatttaaggccttagccaacggattctgacttccggccgtctcataaagcaacagccctaaggcgattccgaggatggcaaccactaccattgacacgatcgtcaaccagattgtttcccacgtggccgacatcatgctaccccaatcgacatttgcaaatttaaaatatgaatctaatccttgatcattcacggttcaagacctccgtttctacccgcatcgtttgtaggtacgctagagcgcccttaatctgttcctgatcacccgttaattggatatacagcgagccaatcgccccttcttgggtttggtggatcccaccctcaataatatttaaatctaacgggtacttcttcaacatctctgaaacaatcggtaactgggcttgatcaccatggaacgtcagttgtacgatagttccctttggatactttgccagcagttgatccacgaccaccgttgtgtcattcagtgacggcgtgacttcttcattcacaaaccgcttagtcacagcctgctgtggtcgtttgaagacttcaagtactggtccttgttccacgatcttaccagcttccatcaccgcgacatggtcagcaatcttacgaatcacgtgcatttcatgcgtaatcaatatgattgtcaaatggagcttctggttgatcgatagtaacaggtccaacacttcatcagtcgtctgcggatccaaggcactagtcgcttcatctgaaagtaagatctgggggtcattcgcaagcgcccgggcaattccgacccgttgcttctgaccacctgataattctgacggataagccgtttcccgaccggctagcccaacgagatctgctaagtgttcagcctttttgcgggcatctgctttagactgaccagcaatttcaagtggaaacataatattttccaaaaccgtccgtgaccataatagattaaaatgttgaaagatcatgccgatcttttgacgttgagcgcgtaacttagccccgctcaacgtcgtgatattaacatcatcaatcactactgacccactagtgggtgtctccaagccgttcagcatccgtaccaaggtactcttaccagcacctgaataaccaacgatgccataaatgtgaccatcttcgatttttaaattaacatcttgaacggcgtgaaccgccccctgcttagcatcaaaggttttcgtcacatctttaaattcaatcaagtcaattcctccttacgcatcaaaaaaagctcctcatcccagacaattatgacaataatcatcaataggacgagaagcttagcctcgtggtaccacccatcttcacaactagctcgcaccagttgtctcaagagttactatgaactccgcatgataatgggtgcgacccaagcttagcttgcaagtgctcactaaacttcattacttcaagaccatcttcagcttcacgattaattcccttacaccaactaggaactctctaagtaatcgtaaccgcgtactcatcttttcaaaatgataacttttttaatcaattgttaatgtaacgagtataccgagcctgtttctaattgtcaagacctgacaattagtccacatcgattaaccaagcaacgccgtcttcaacgctgttcaacgcatcgaaattctcactcagcgctgggttgaccgcaacaacggtcccgttaattgggcagttgaattcagaaacggccttagttgcttcaacacttagaaaagcgctgttttgactaaccttgtcgccgatagctggtaattcagcatacttcacttcaccaagggcttcatgggcagccttagtcaaacctagccgcgtatgcccatcaacatcttttgtccaaaaataagctgcatcttcactcatactaaacaccatacctttacaataattttactattcaaaccggtcattacgactgaacatgtaggacttgtaatgataccgcatcgacatcattaagccaatcccggccatattggcaatcaacgccgaacccccttgactaataaacggtaagggaatcccagtcattggcaataatccgatactcatcccaatattttcgaacacatggaagagaatcatcataatgaccccggttgaaatgtaagcgtagaattcgttcttcgtatcaaacgtcactcggatcatctggtaaatcaataagaaatacaataaaataaccacggcacaaccgataaagccaaagttttcaccaattaccgagaaaatcatatcggattctcgcaccggaacagtcacgtgagaaacgttaaaaccccgcccggtaatctgaccagagccaatcgccttcatactctgccaaacttgataggcattgttagacgtatccgtcgacggattcaaccacgtatcgatccgggcaaattggtactgcttaaaaccgatagcttccaaaatatggcgaccgctctgtgagatcacaaggtataacgcggtccccgcaatcgccgccacaatagtgaacgttggtgccaacaatcgccacgagatcccggaaactaagataacgcccccgagaatcgcgaagaacaccagcatcgtcccaaagtcattttgtaacttcaaaaggatggcaactggcaccatgtacgcaattaacttcccaatgagttgccaatcgctcgccatcgtgtgcgtcgggtgctccgtgttatgcatcgtcacgactcgcccaagcatcaagataaaggcgggcttcatgacttcagacggttgcaacgtcaaggaaccgaccgcaaaccaacttttggccccagtactctcaaacagcgatctactgtagaggaccaggacggccgctagcaggaagatcccaaaccaataggcaatcggtgccactcgccataactgttctgagtcaaactgcatcacaattacggcaatcgcggtcccaatcacgaaccacatgacttgagaaatcacctgcttcgtgacgttcactgaactagaatcgtgcactgcggcgacgtaaatcgacgccagcccgatgagtcctagcatcatcactgaaaatatgataccccagtcaattcttgaatcctcgtcttgactgcggagtctagattcttctgccacaaataacgctcctaacctgttggaattagcccaccgcacccggtagaccaaccctattcacaatatcattttgtactttaagatagttttcattatacaacaacctggtgccgaattctcggaaccaggttgaaggtttactaaaaattagcctttgtgtagatggtaggccgacaagatctcttgcagactctcatcaaaagatttggtatgcgcaaatggttggttgtcactgaccatttcagcttcaaatcgttcaccaacttgagtcacctggccaatcacttgtttaccgatcagaacttcggtaactggttgaccgttgaccttcgtttcgtttaaagtgaccgaaatcgccttatcttttcttgccacggtggtcttcctccttatattgcggattacgacgcaatgaaaaatgggcgggcaccggatcaaagccacccttaactaacggctgacagcgtaagatacgtgcaattcccattagaatacccttaactgcaccaaaccggtcgatcgcttccaacgtgtaattagaacaggttggatagtagcgacaatgagccggactaaacacagaaaaggcccgctgataaaagcggatgcctttcattaataaccgtcgcatcttaatttatttcttgttcttagcagttttctgcatatgttcaagcaaaataccagcaccctgagcaacattattcaatgggtgttcggcaaccattacgggcacctttaagttttcgctgatcaattgatcaagcccactcaacaacgcgcccccaccggttaacgtaatcccccggtcgataatatcggccgcaatttctggtggtaaggtttccatcacgtgatgggccgtgctgacgatttgcatcaacgtttcgtgaatagcttcttcaacttgattggagtcaatgtcgattgagcgtggcatccccgtcacggtatcccgaccgcgaacttgggtcaccttatcatcgtcgccgtcctgcttgaagacttgtgcgatttgaatcttgacttgttccgcactgcgttcaccgatcaacaagtgatgttgatctttgacgtagttcacaatgtcttggttcatccggtcgccggccattcgtaatgaactgcttgcgacaatatcgcccaatgagagcacagcaatatcactggtcccaccaccgatgtcaatgaccatgttcccacgtggttggaaaatatccatccccgcaccaatggccgccaccttgggttcaacttccaggtaaaccttattaccgccagatttttcggcagcttgtaagattgctttacgttcaatctcagtggtgttcgttggggtacagatcataatacttggccgtgacataatcccacggacatttaattttttaataaaataggatagcatttcttcggtgacatcaaaatccgaaattactccgtcttttaatggtcgaattgcccgaatgttactaggcgtctttccaaccatttggtaggcttcggacccgactgccaacacttgattcgtgttcgtatcgatagcgaccacggatggttcgttaaggacgatgcccttacccgatacgtaaattaaaacattggcagtacctaagtcaataccaatatctaaagccatgtttttgctcctctcaaacatacaattatacgactaatcattataccatactctacagttgatgagaactgacggctgtactagtcgcccgtctacttgccactagcaaccaatcggtgcgagctaatcatcttgccgtttcgaccattcatcgactgtcaacgaatagatggcttcgtcacgatactgaccattcaacagaatattttctggcagggtcgcgtccaaatgatattggcgccgctctgcaactgcccggctagctttattcgcaacgtctgcacccaagatgaccttgtgcaggtcaagttccgtaaaggcaatttcttccaatcgttcgagcgccttagtcatgcccccccgaccagtatacttttggccgagccagtagccaatctcaccgttgtgattaatggcactaatattatgcaagtcgagcatcccagcgacttcgccatcgacaatgatggtggtgataaacacctgtccatgtgcctgcttggtcaacattgattcgataaaatgacgctcgtcttgcacggtcgccgtcgcatcaacccacggcatccatggcttcaaatgatcgcgattatgatcaactaagtcgaaaagcggctccgcgtcagccacttcagttggtttcaatgaaatgtgtttgtcgataatattaataaacataagctgtcctcctgaatgttggcgccgggttaccccgcttcgccacaaaaaagccttcaaaaacgagtttatcgcactttgaaggttttgtaagcaattatttcgatttattcggcagcttcgttcgcaaaatcagggttcaacgcataaacggtaccatctggaacgtccacgcgtttgatctcagcacctaatttagccagcttaccatggaagttaaagtagccgcgatcaaggtacttcaaattagtcacttcggtgtagccccgactgaccagtcccgcgattactaacgcggcagcagcccgaagatcggtcgcagtgacctgggccccgttaaagtcagtgggaccatacataatgacggagcgaccttcaactttgaagtcggcgttcattcgccgtaactcatcaagatgcatgaagcgattctcaaagaccgtttcagtcaataaactggtgccttgcgcacacaactgcaaaatggtcatctgtggttgcatatccgttgggaaacccggatggggcatcgttttaacggaagttggcttcaaggtttccggaccaatgacccgaataccagccggttcttccgttaccgtgacgcccatctcacgcatcttcgagatcaatggcttattatgttcggcaatggcatcttcgaccaaaacgtttccctgggtcaccgcagcggcgaccatgaacgtcccggcttcgattcgatcctgaacgatgctatggtcacaaccgtgcatcgctttgacgccttcaatgcggatcgtttcagtaccggccccagtgaccttagcacccatttgattcaaatagttcgctaaatcaacgatttcaggttcacgcgcaacgttttccatcgtcgtgatgccatctgcaagtgttgccgccatcatgatattctgcgttgccccaacacttggaaaatctaagtaaatagccgctccgtgtaactggttcgcagtcgcttcaacgtacccatcgtggcgttcgatttcagcaccaagggcattcaagcctttcaagtgtaggtcaatgggccgtgagccaatcgcacagccacctggcatggcgacctttgcatgacctaaccgcgctaataatggtcccatgaccacaattgacgcacgcatcttggacacgtattgaaacggtgcttccgatgataattgacgactagcgtcaatatcgatggttttattaatttcatcaaaatcaattttagcattcaaaaactttaagacgttattcattgtgaagacgtctgataacactggtacatttgataaatgtgtctgtcccgaactagccaacaagcttgcagctaaaatcggtaacacggcatttttagcgccctcaatatggacatttcctgtcaaacgttgaccgccatgaactacaatttcctccatggataaaccctccatcactaaacgataatcaataaacaagttacgtgagatttcggattgcgtaaaaagcacacttaattaaaaggacgtgattgaatcagatgccgcgcacctgcccaaattccactgttcaccgcgataccgatcaagtcggtcatacacggtatgcaatccaaacaccagctcaaccatcaaactcgccaacaacagcgcgcaggttcaaatcggttcctaatcatcataccatagaacaccaggggataaatattacattttacattttcgttacaatttcaacacaaatattaaatacttatgattagttaactaattagaagttcgtcgcccaatttgttgacaaagcgtggctcgcttaaccagcaacaccgtttaatcgtaatcgttttctttgttgtaataccactataagatgcattctaacattcaacttagtgcaacgcccctaatacgctcaaccgattagaaaaagtcggaccgcgaccgcctctatccgcccgtcactgtggataacattgcgggtaagggtggctcattaaaatggttaagtttgccgtaaacttgcgccttgatattggcttgagggcaaaaaaaagcacccgcaaataattgcagatgcttttcagaattttaagttgttaatgccgggcaacgttcaaccggttcatggcacgccgcagagcgacttgggcccgcgccaactcagcatcatcatgcttttgttgggcatcttgaatccgggtttcagcgcgtttccgtgcattttcagctcgggcaacatcaatgtcattctgacgttcagcactatcggcaacaatcgttgctgtattatcgctgaactcaacaaaaccgccgttaacggcaatttcgtcatcttcctgatcactctcaagttgcttgatccgaacctcatcgattgcaagtgacgcaatcaccggaatgtggttcggcaaaattccgagttcgccgtcaatcgttcgcacgatcaacattggcgtcttattctcatagacctgaccgtctggagttacgatgctaacggttaatgattttgcattgtcagccatgtaaacccctcctaatcagttaccatcgatttcgctttttcgaccacgtcgtcgatcttaccaacttgacggaatgcgtcttctggtaggtcatcatatttaccttcaagaatttctttgaagcccttgatggtatcgttgattggcacatacgaaccaggttggcccgtaaagttttcggcaacgaagaaattttgtgacaagaagaattgaatccgccgtgcacgtgcaacggtcgtcttttcttcgtcagataattcgtccatccctaaaatcgagatgatatcttgcaattcacggtaacgttgcaagacccgttgaacttccgttgcaacttgataatgttcttcgcccacgattgatgggtccagagcgattgaagaagaagctaatgggtcaacggctgggtagatcccttgttccgtcaaagaacgttccaagttggtcgtcgcatccaaatgggcgaaagtcgttgcaggtgccgggtcggtataatcatcggcaggcacataaacggcttgaatcgaagtaactgaccccttcttggtagaagtgatccgttcttgtaattgacccatttcagtggctaaggttggttggtaaccaacggctgaaggaatccgaccaagtaaagcggaaacttcagaaccagcttgcgtgaaccggaagatattgtcgatgaataacaacacgtcttgaccttgaacatcacggaagtattccgcaatcgtcaaaccggtcaaggccacccgcatccgggcaccaggtggttcgttcatttgaccatagaccatggcggtattcttcaaaacgccggaagccttcatttcgaagtaaaggtcattcccttcacgcgtccgttcaccaacaccggtaaacacggaaatcccgttatgttcttgggcaatgttatgaattaattcctggattaaaacagttttaccaacaccggcaccaccgaacaacccaatcttaccaccacgaacataaggtgctaagaggtcaataactttaatcccagtttccaatacttccgtactggttgttaattcatcatatttaggcgcatcccgatgaatcgggttacgttctgcgtctggaccgaattctggaccaccatcaatggtttcccctaaaacgttgaagacccggcctaacgtctctttaccaacgggaacagtaattgaagaaccagtgtcttcgactgtcattccccggcgcaagccatccgtaccatccatcgcgacggtccgaacaaccccatcacctaattccaacgatacttccaccgttaaagtgtcatcgttgtccttctgaatgatcaaggcgttattaatatcgggtaacttatcgtttagagagaattcaacgtcaacaacgggtccaataacttgtacaactttacctgtactcattagtcgttaattcctcccacttcgttattcttgcgcaaccaaaccaccagtgatttcagtgatttcagtggtaatagcagcttgacgtgcgcggttatatttcagatttaatttatcgattaaatcgccagcgttatctgatgcagccttcatcgcggttgacgacgaagcatgttcagcagtcttggcatccaagattgcaccataaaccaagctttcagcatattgtggcaacacggccgacaaaatggcttcttctgacggttccatttcatactcgggaccgacatctacccggctatccttggctttacgattatctgactcactttgttcaaaggtctcttcggagatcggtaacatcttaacggcccgaaaaccagaagagagccgattaataaagtggttgtagaagacgtagagttcatcaaagacttcgttgtggtacattgatgtgactgtcttaacgatttcacgaacttctttaaaagttgggacatcagagacgccgcggtactcataagccacgtttaacccgttctttttatagaaatccgcaccagtgccaccaaccgccaaaacgactgcgttatcggcatcaatcttgtgcgtccgcatgaaatcgttagtctgtttcaacacgttactgttgtaactaccaacgaggccacggtcagaagtaatcaccaataaaccagtctttttaacggggcgttgcgcgagcaattcactaactgaaatcgtattcgaattactgttagcaacaccggcacttgctgacatcagatgagctttggcaagatgtgaaacgatgctttcaactttagaagcgtacacctgatacgtgctggtatgcttttgaatctggttcaattttgaagttgagaccatttgcattgccgacgtaatttgatgagtcttctttgttgagtcaattcggcgcttgacatccattaatgattctgccatgcactactcaccatccttttcagccataactacttcgcagcggcagcggttggctggaattgttctgcaaaggcatctaaggcactattcatcttatcagcttctggtaacttcttagttgccaaaatcgtatcaaagaggtcctgatgactcgcatgaataaattcaaacaattcactttggtaacgggcaatatcatcaactgccactttatccaaataaccgttggtcaaagcatataaaatcattacttgttcttcgaccttcaatggtgaatgaacaggttgttttaagacttcaacgatccgttgcccacgatttaatttcgcttgggttgcagcatccaagtcagaaccgaattgtgagaaggattccaattcacgataagaagccaagtccagacgcaaggtcccggcaacggacttcatcgctttaatttgcgcatccccaccaacccgggaaactgaggccccggcatcgatcgctggccgcacacctgaatagaatgaatcactatccaagaagatttgcccatcggtgatggaaataacgttagttggaatataagccgaaatatccccagcttgcgtttcgataattggtaaggccgtcattgagccgccacccaattcatcgctcaacttggcagcccgttcgagtaaccgtgagtgcaagtagaagacatccccaggataagcttcacgacctggaggacgacggaggatcaaggaaagttcacggtaagccgttgcttgttttgaaaggtcatcatagacgatcaaaacgtgcttgccgttcatcataaattcttcacccatcgctgccccagcataaggcgctaagtacagtaatggcgctggttcagcaggcccggcagttacaacgatcgtgtaatccatcgcacctaacttcttcaacgtttcaacttgggcccgtacagttgagtccttttgaccaatagcaacgtagacacaaatcatgtcttggtccttttggttcaaaatggcatcaatggcaacggacgtcttcccagtcttacggtcaccgataatcaattcacgttggccccgaccaattggaactaaggcatcaatggccttgatcccagtttgaagtggttcgctaactgattgccgttgcataatcccaggagctttatgttcgattggccgcgtactcgtggtcttaatctcacctaaaccgtcaactggttggcctaacgggttaacgacccggccaatcatggcgtcaccgactggaacttccatgatgcggccagtccgcttaacagtatcgccttcacgaataccatcaaaatcccctaaaacaacgataccaacatcgttgctttcgaggttttgtaccatcccgtaaactccgttactgaattcgagtaattcaccttgtaaggcgttgtcgagtccgtgagcacgggcgatcccatcaccaacgtaggtgacagtaccggtttcagcaactgagagctcagtttgataactttctaattgttgtttgattagagcactgatttcttcagatttaatgctcataaaagtttcacctcttcgtaaactaattgttgatgagtgctcgtcttaaattcgttagttgtaacgcaacgctaccatcaaacgtttgattatttgacttcacaattacaccgccaatgattgcttcatcgactttacgtgacaaaacaacctgattggcaccaacgcgtttggcgaatgcctttgcgattgcatcagcttgctcatctgacaacttgaccgcagacgttacttcggcatgcactattttgcgactctcatcgaaacgtgcttcaaacgcgtcaacaatgccaactaagttcgacatgcggccgtaatcatacaacatttgaataaagtttttaatgtattctgaagcgtggtcagtcaaagttgacaacgttgtctgtttttgatcaaccggaagcaatgatcctgagaggacctctgccaattgcgggttgtcgacaaagacttgccgtaattgctttaactcggccaggaatgcttcggtctgatctttttcaactgcaagttcaaagagtgcctttgaataacgactggcaattgtaagattatcaagactcatgctttcccaacccttcaatatacgaattaattaatgcctgttggccttccggatccaattgcttcttaataatcttcgtagcaatcgcaaccgaaatgtcagcgacgtctgattggacgttcttcaaggcatcttgacgctcctgttcaatatccttacgcgcattttgtttatactgcgttgcttcgttttgcgcatcggcaacgatacttgaccgttgcttttcgccactctttttcgcgtcagcgacaatttcactcgcttcagcgcgagagtgtgatagcgcatcacgccgttgatcagctaagtcactcgcttcttgccgtgacttttgtgctgaatcaatgtcgttcgcaatcttgtcagctcgatcagccatcatttttgtgatgggcttccaagcaacaacagagatcaatgccatcaaaacaataaagctaatcccgataaacaacatatcaccaaggtagagaccggatgcaccgataattaaatgcgagagcatctaatgacacctccttctttcattttcattaaaatgaactcgttgaccaatgattacttgttcataaccatcaaagcaacaacgaaggaaatgataggcattgattcgatcaacccaacaccgatgaacatgttagtccgtaattgaccagataattctggttgacgggccatcccttcaagcatcttagaaataaccaaaccgttaccaataccagcacctaaagcggcaccaaacatagcaatacctgcagcaattgctcccataatctgtgtatcctccttaaaattaaaaaactagaaattattcctcgtcgttaaccttctgagaaatataaactgaagtcaaggttacgaacacgaacgcttgaatgctcccgataaacactgagaaaccttgccataagagttcaattggaaatgagtaaacatagctcaaccaaccgttgctctttgccaaatcagcaaccttcgttagtaacatttcaccagcaaagatgttcccgaacagccgaagacctaaagttaggaaatcggtaaattgttcaaagacgttgataaccgagaatacggcgaaaggttgtgtgtattctttcaaataaccacccataccttttttccgaacacctgcagcatgtgcaagtgcgacggtcataaacgataacgtcaaagtcacaatcggatcggcggttggactcttcagatacgtgtactgcccgacctgaacgtgaatgaacaatccaagttggttagcgatgaagataaagagaaacagtgtaaatgcgtacaaactaaagttagacgcttcgttccccttgatcgaccctttgacaatgccattcgtgaactcgatgagccactccagcacattttgtccacccttgggcttcatagcgatatgtcgcgaaagtaaaaagacaaacaagaacacaataagacaagtcacaactactgagatgtcattcgcgatattaaacgtcagtccaaggaatttgactgtaggaactggatcacccactgaatatcacctctttcctttaatttcggtgctacgataaccttaacctttgagctagtcaacgtcaattttatcgtaacctgaaatggtagatcagggtcacccctaatcaaaatacaaaggtaataataccaccaccgtcgaaaaaattcaaaataatttcaacatttcgtcaatcaataaaaatccaacgatatcaagctttcattaagctttcaaatcgttggattttcatcatttcgactttattttcattcttgacgcgcgccaagacaacttacttctcatttaccgccgtcttcggtagcaccaggttcatcacaattccaagcaccgtggcaaccgccagaccactgaactgaaagctccctagttgcaaataagcattgccaattccaataaccaaaatcgctgatgcaatcattaaattccgcttctgattaaaatcaactttattatcaatcaggattcgcatcccacttgaagcgattaccccaaacagtagaaaactgaccccaccaatcacgggtgatggaatactctcgatcaacgcagataatttacctacaaagctaaagacaatggcaaagaaggcggcaccgccgagcacataaatactgtgaactcgcgtaattgccagcaccccaatgttttcaccataggaagtcacgggtgggccaccgacaaagccggcaataatcgaggccgtcccgtcaccagccagtgtatggttcaacccaggatccttgaagaaattccgcttggtcaacttattgagtaccataatatggcccatatgttccgacatcgtcacaaaggcgatcggtgccatactcagaatcgcgccccaataaatacccggatgataactaataaagggtagctgaaaggccggcatcgcaaaccactgcgccttctccacaccagaaaagtcaacgattcctgctaacacggcaatgatatagccacagacgattcctagtaagatgggtactaaactcataaagccacgcaagtacatgttaaaaataacagtgagcagcatcgttgccatcgcgacaccaaagtatttgatatcataactgctcccattcatcgtcgcgtccttcgccgccgttcctgcgagcgacaacccaatcaccatcacgattggccccacaacaattggtggcagcgccttatcgatccagtctgaaccaattaacgtgaccaataaactaactagcaggtacacacaacccactgcgaccgtcccttgggcgattgcaggatatcccgcggtcttcatcagagactgcatcaccacgatgaatgaaaaactcgagcccatatacgccggaatcttcccccgcgtaattaaaatatacattagcgtcccgacacccgaactgaacaacgcaatccctggatttaatcccaccaggatgggcaccaataccgtagaaccaaacatcgagaacagatgttgcacggacaagcctaaccaactaccaagctttggtcggtcatgaatatctagcacgacttcatcattatgaaacgccgctttctttgtcataacgcaccccttttatgaataattgcaaaagaaaagacagcccaccactcaaagcggctaggctgtccgaaattacgcacggcttccttaaaagcgcacgtccgttcatccttttcagcctctctgagctaatttaaaggaactgtttaattgcaattagtctactcgtctccgaaataattgtcaaccaatgtttgacccaaaccattgacacccgaaaaaaacacgatgtcagccccaaacatcatcatatttgtgacaacattcctgaaataatgttacttttttacccaataacaccgaatattcggaccacacaacctaaccgccacctaaaaactcccgattgtccagtataccccaacagttaatgtcaataactacctataatatacgcgttgtgcaacttatcatttcacatcaatcttgattaaaacgtgctggttgtgtaagttcagaaccagccagctgaggcccactagaaacagtaaaattgcttgattcgttcgtcctacgccgacttccaggcatttctgccaattgccggaacgtggtgggcacagatttaagccgaagcccacgtcttaaatactggcctttcactaaccaagcacaagacgcttgctaagtgaaatttcaccactgggcattgtcagaaacgccttccagtcgggacggtattcgaatggcagacggagatgtacccaacctttgatgaatttgtcatcgttcttcataaacggtaattttgtcaatcaactgtcagactgaaagtgatattgagatagctcaacaggtctgaattagaataataagattgaaactcctgacaaagtgccttatgcatcctaaccctttgtctaaagttcccgtatcaaaatagtcagcgacaaattgtaccaagttaagtggccgttcatctgccattcgagcggcataccgactggaggggctgggtgacaatgctcagtagccaaattattcttagtcggaagtgaatttcttccggcttagaataagactcgtatttgagaccgggcgggttgtgcacgggctcaaatcgacgtcggcttacgttccagcaattgtcacccagccccggaggtcggaataggacgcgcaccggctgacgaacaggaatctaaacttggcacgttttaatcaagattcgtgacagatgggcttacaggggtggctgatggctaaagttgttcataattttggaaagtaaaaaggtaggactaccaggcatgcctggtagtcctaccttttatcaatgcaacttacttcgtaccaaataaccggtcgcccgcatcgcccaaaccagggacgatgtagccatcttcatttaaatggtcatcaagtgctgccgtgtaaatatcgatgtctggatgtgcgtcccgtagtgccttaacaccttcaggagccgcaactaaacacataaacttaatattacttgcgccgcgcttttttaacatatccattgccatgatggctgaaccaccagtggctaacattggatcaacaacaaataattgccgttgtgaaatgtcacttggtaatttaacgaaatattcgaccggcttcaaggtcttttcatcccggtacatcccaacgtgcccaactttagctgccggaatcatgtttaagaaaccgtcaaccatgcctaagccagcccgtaagattggtacaatggcgactttcttacctgccaacgttttttgcgttgatttggcaatcggtgtttcaatttcaatgtccttcaacggcatatcgcgtgatacttcgtacgccatcaacgttgaaatttcgttaaccatttcccggaagaccttagtaccacagttcttttcccgaataatcgtcaatttatgttgaatgagcggatgatccaaaacctcaaacttacccatgttgctacgcacactccttagtgatttctttctattgtagctaatttagagagaaaaaaccagacctgatataaattacttaatcaacatcaatcgggtgttgagctgttaacgccatcgcttgttgtttgacgtcatcgaggtttgcctgatctgtcggcgcttgtaacgcttgcaagatcaactcagcgaccttcgttgcatcggcttcatcgaaaccacgggtcgtaatcgcaggtgttcccaaccgaatgcctgaggtcttgaatgcccccaatgtctcgttaggaatcgcttctttgttgaccgtaatataaaccgtatctaacagatcttgtacttggcgaccgttcaaaccagacttagtgacatcgatcgtcatcaaatgattgtccgtgccaccagaaataacccgaaccaggtcagagtcattgaagaccttcgccatcgccttggcattatcaatgatatgttgggcataaactttgaactcaggctgcaagtcttcgcccaaagcaatcgctttaccagcaatgacgtgatccaacggcccaccctgattgccagggaaaacggcggagttgatcttcttaccatacttttcttttgctaaaatcataccgccacgaggtccccgtagcgttttgtgcgtcgtggtcgtaaccacgtcagcatatggcactgggtttggatgtagcccggccgccactaaaccggcgatatgcgccatatcaaccatcaatagcgccccaacttggtccgcaatctcacgaaactttttaaaatcgatcaatcggctataagcagaagcccctgcaacgattaactttggttgaaaatcttgtgcttgcgcaagaatggcatcgtagtttaattcctcggtttcaggatcgagcccataaccttgaaaatcataaagtttaccagagaagttgacactagagccatgtgttaagtgtcccccagcatctagtgacatccccatcacccggtcaccaggttggatcagggccatatatgcagccgcattagcttgggaaccagagtgtggttgcacattagcatattccgcaccaaataatttcttagcccgttcaatggctaaggtttccacttggtcaacgtattcgttaccaccgtaaaaacggtggcccggataaccttcagagtatttattagtcagcacactcccctgtgccgcccggacgccctttgaaacgatgttctcagaagcaatcaactcaatattgtgttgttgccgtgcctgttccttactaatcgcagcccatacttctggatcttgttcctggtaattcatgaataaatctcctccatttcgcaagtgacaactttcgggttttcccgacttgcaatcattatacactaaaatgagtctgaccggcagatttatttaatcggttcatgtaagcaagcccaagccctttattttcaaaggcctggcacagaatatcttggatttctgtctcggtatcgaagtgtcgtaaaccagcgaacagctctcggcttgccgattgaatatcgtttccaagcgaaaattgttcgcaattagccggaatctgattgttagttaaaatatcatccgttgccataacgcccataggtacatcttgctgggctgcccatgttaacgcttgtggccaatcttccgaacgatcaacgatataaacctgtgcgttcggcgcatagtgcttatatttcatccccggcgccttaggaacttccttggccccaacatggtgcaattcagtttgaacaggcatgccaatgacccgctcgattgcttcaggtgtcactgctccgggccgtagaatcgcaggttgatccgtcgataggtccaggaccgtcgactccactccgactttagtcggcccatcatccaaaataccagcaattctgccgtgaagatcatgtaacacgtgctgggccgttgtcggactaggctttccagacgtattggcggacggtccaacgattggtgttcccgctgcacgaatcaaagccaaggttgcctcattatcagggttacggaaagctgccgtctgcaacccaccagtaacttctggcgctaatgcgttcggtttcaacttaaaaatcatcgtcaatggccctggccaaaatgccttgatcagcttcttggctgcttccgataatggttgagcaaaccgctcaacggtttccacatcggcaacgtgaacgatcaacgggttgtcactaggacgtccctttgcttggtacacttgcttaacggcagccacatttgtcgcgtcggcacccagtccatagaccgtctccgttggaaatgcgactaactgcccagcagtcaacaacgccgccgcggccggaatctccgccggcgtatatactttcgtttccataatattcaaacctctactttactattaattaattattacttttatataatcttctttattatttacatgacagcctgatcagccaatcatgaatttgagtagcacacacgttgcctccaagtctaaagtagccaacttagaataaacctcacatttgaaatcacccacttgtgcgtcaactcatatcactaacgccgttcacccaaccccgaaggtcgagagagcgtatcgcgaatgaaccgggactagccatcggcacttatctcagtattccccttaaaaaatcagtccaacgattaccgagtcggagccattgcaactcgtagcatccgatcgtgacccgccatgtcttgtcgcagcgtcacggtcgcgtctggcatcgactgcgcgaaaagctgctgcaaagccgacccctgatggtagccgaattccaagtataagcgaccagttgaggtcagatgatcggccaccgtcatcgctaactgctcgtaaagcgccagcccctcgtgggcagcaaataaggccgtttggggctcgtgggcgaggacgctggcgtccatgacgtctttttcgctggtggcgatgtatggcggattgctgacaataatatcaaacggctgcgttgaaacactcgtcagtagatcactgtgaacgaacgcaacgtctaaatgaaggcggtccgcattggctttggcaacttgcaacgcagcggttgaaatgtcgctggccgtaatctcccatgccggccgttcgtgtttgattgccaatgcaatggcgcctgagccagtaccaacgtctaagagtcgcactggcgctgtcgctgggacatccgtcaaaatccagtctaccaattcttctgtttcgactctaggaataagcactgctggattaacttgtaaggtcaggccataaaacggtgcggcgccaagcacgtactgcaccggctcaccagcaacgacccggtcgattccctgttgataagcgcgccaaacgtcactgggtagtggctcgcgataatgaatgagtaattgcgtctggtcgagccggctcaagcccaataacaggaagcgagcactatcggtcggcaactgggccgtttttagacaaaaagaagcccactgctgggcttcaaaataagtgggttgaatgggcttattcattagttaagcgctccatcttttcagcttgatcagctaaaacgagggcatcaataacttcgtctagctcgccgttcatcactcggtcaagtttgttgagcgttaacccaatccgatgatccgtcacccgattttgtgggaagttgtaggtccgaatacgttcagaacggtcccccgtcccaacggctgatttacgttcagcatcatattcgttttgttcccgtgattgatagtagtcgtaaacccgggcgcgcaagatttccatcgccttggcccggttttgttgttgcgaacgttggtcttgcattgagaccacgataccggttggtaaatgggtcatccgcaccgctgaagacgttttgttgatatgttgaccaccggcaccagatgaacgaaagacatcggtccgaatatctttttgatcaatatcaatgtccacatcctgtgcttccggcataacgccgactgttgcagttgaggtatggacccgcccagctgattcagtcactggtacccgttgtacccggtgtgcgccactctcatacttcagtttagagtagaccttgtcaccagaaataatcagaacgatttctttaaagccaccgacttcagtttcattccggtcggccacttctacttgccagccctgacgttcggcgtacttcgagtacatgttgaacaggtccgcagcaaatagactggcttcgtcaccaccagcagcaccgtgaatttccatgatgatgttcttgtcgtcattcgggtctttaggcaacatcaataacgtgatttcatgttccagttgatccttttccgcgttgaggttctttaaatcatctttgaccatcgcgttcatctcgtcatcgagcttttcatgaagcaattcgtcattttcttcgatctgactcgtcacttctttgtagtgattatacttttcaaccgtttcacgaatattacccatttccttagataacttcatgaaacgttgagaatccgaaatgacttccggatcacttaacaattcaccgagttcttcataccgatcggcaacggcttgtaacttatcaaaaaacttatccattctcagttaatcctcactttgttaatttcggcgggtaaaaataatgatgacgacaaactgggtagtacgcctcattacccccgatttgaacttgttcgccttcataaacgggctgaccatcgtggaaccgtaaattcataattgcttttttacgacagaaccagcagattgtcttcatttcttcgatcttgtccgcatatagcagtaggtacttgctaccttcgaacaattcgttacgaaaatcattctttaaaccaaacgtcatgactggaatctttagctcatcaacaatgtcagccaattctaggacgtgatgctttttcaaaaattgggcttcgtcgattaaaacgcacgccgcatccggattcgtttgtttaacgatctcaaaaatattggtatcatcaaataccggcgttgcttcacgtttaaggccaatgcgacttgcaacatagcccacaccatcacgattatctaagccactcgttaagataatgaccgacttatcttgttcctcatagttatgggcaactttcaaaatttcaatggttttaccactgttcatcgcgccatatcgaaaaaataactgcgccaagcgactcattccccttttttacacatttctagtcaattatagcggatttggccgtgaatttcagcattctgtcattaaaactaattaacgaattgataatatgcggttaaatggcgggagtatcacttttcttttagggacgttcagtataaaatacttgagagtaggacattttgtccggtaattatgattttaatacccggtagttggtcacactgatcatttcccaggtaaatcaagaattaggggtaccgataacttatgtcaattaatagtacattagccacctggacgggtaaatccgcatattggtttttacacaccttccgtggcggcgggagctcactccccggcaagttagcgctgaagctcgatccaacgattttaaagcatctcgctaaaaactacgacgtcatcgtcatcactgggaccaacggtaaaacgttaacgaccgccttgacggtcaaggttttacgtgaacagtaccctgacattttaaccaatccaagcggatccaacatgaagcaagggatcgtcacgacctttttacgggcacctaaagcgcaccaaaagccactcgcagttctagaagtcgacgaagctaacgtaatcatggtcaccaagtacatcacaccaaaagcctttgtcttcacgaacattttccgtgaccaaatggatcgctacggtgaaatctatacgacctatcagaagatcttggacggggttgctttagcacctgaagcgacaattattgccaacggtgatttgccactcttcaatgccaaacaattgcctaatccgatactgtattacggatttgactaccagcccgaccatgatcaacaagcgccagcaaatacggatggcttgctctgtccacgttgtcagcacatcttgcgctaccatagtcgaacttatagcaatatgggcaagtattactgtccccactgcggttttgagcgtccacggttgacttacaaattaaacgctctgactgccatgacaccgactagctcagactttgaaatcaacggtcaggccatgcatcttaatatcggtggccagtataatatttataatgcgctagcggcctacgcggttgggcgcttcatggacgtcacaccagctaaaatcgcgcacgcccttagcgacaacgatgaacaagtctttggtcgacaagagacctttcacgttggcgaaaaggacgtcacactgattctcgtcaagaatccggtgggccttaaccaagtcttgcaaacaatcagcaccgatgagcgaccattctcatttgccgccctgctcaacgccaactacgcggatggtattgatactagttggatctgggatggtgactttgaaaaactaccggcattgaatattcccgcctatattagtggcggtgaacgttaccgtgatatcacgttccgactaaaagttgctggcgtaccggaagatcagttaaccattgttcctgacctgaccaacatgacgaccgcaattcaaaaactaccgaccaagcaagtctacgtcgtcgcaacttacaccgcgatgttgcaattacgaaagcagctcgctagccaaggcattattgatggggggatggcttaaccatgacttatacgctacacgccgcacacctctacggcgatttaatgaacacgtacggtgatatcggtaacatcttagcaatgcgctactatgctaaagcagtggatgccgacatcactgttgacttagtcagcttggacgacccgtttgacggcgataagtatgacttcgccctctttggcggtggtcaagattacgagcaaacgattgtttccaaggatctgcaaacgaaaaaagacgccttgaccgcatatatcgaagccggtggcccattattagcaatctgtggtggctttcaaatgctgggccattactacattggggcccatggtgaaaagatcgcgggtatcggtgccttagatcattacacgctcagtcaggataacaatcgctttattggtaatatcactatcgagaacgccgaaacccatcagacctattatggctttgaaaaccataacgggatgaccttcctgggtgaaggtgagcggccccttggtaaggtcctccaaggcaacggcaataacgggaaggaccaatccgagggtgtcatctacaagaatacctttggttcttacttccatggtccaatcctcgcccgcaacgaagccctcgccaaacgaatcttaaaactgtccttacaacgtaagtaccctgagggcaacttcgatgcactggaccaactcaatgaagatctcactaaaaacgttgtcgtgaaaccttaatccgcagtactaaagaatcgctcttaacccagttgcgggtcaggagcgattcttttggtttacgatccactagtccggatcacaacgcgacttactttttggaagccctctcattagtgaacccctttaagctataataaatatttatatacttttagatagtaattattaataaactgatattatcagctaacatacaaaaaaagattgatattggctctaagccagtatcaatcttttttatcccatcaggggtttaactaattaagccttggccccgggttctgacgcaataatttgtaaatcacccttcaacgtccattgtttaacatcaaatggcaagatgaagtggattcccttactcaatggataatcctgaccatcaacggtaatgctcccttgaccatccagtacggagactaacgtataaggtgccgaaccccgattaaaggttgcttgaccgttcgttaaccgccattgccaaacaccaaagaatggcgattggacgtacttagttaccgtggcgtccccaacttgcgtggttgtgatatcaagatcagggtcatgatgcggcacgttagttgtatcaatcgattgttgcagatgtagttcccgcttctgaccagtagtcttatcgacccggtcccaatcatatagccgataagtcgtatcagaactctgttgggtttccaataccataatccccttaccaacggcatgaatcgtaccagatggtacatagagaaaatcgccgggtttcacggggactcgccgtaacaacttatcccactcaccattgttgatccattcggcgagctgttcacgagtcttggcatgatgaccataaatcatcgttgcacctggctcagccgcaatcacgtaccagcattcagtcttgccgagttcgtgttcgtgttcagctgcgtacgcgtcatccggatgaacttgcactgataagtcttcactagcatccaggattttggtcaatagtgggaagacatcccccttggcattaccaaatacatcgcggtgctctgcccatacctgatccaatgtcataccagcatacggcccattttcgaccgtcgctggcccatgtggatgggccgaaattgcccagcattctccagtatgatcactaggaatatcataatcaaaatcgtcatgtaatttggtaccgccccaaattttttcatggaacactggcttcaaaaagtatggctcactcataagatttactcactccattgttaaatttaatatctaaattttagcatacatgaaagcggttgtgaaaccgaactaactaatttgtaaccgtatccgccaaccatgccgcaatcaatcgtcgccgtgcgggtaggaatacagaattattcgcaaccgggtgtacccgattggataagaacacgagtccctgttgccgttgacgatcgagcatcaggagcgtaccagtatagccggtatgaaaaatcactggcatcgtctcatcaggccggtgccagaggttccagccaaagctccggcgtagatgttgattaggcgtccagtcttgatataaactcgcaatcgtggtctgtgatagcacttccggcacatcgatttgaccgagcatcagtcttgaaaaccgaacaaggtccgccgtactggcaaataggccggcggacccacagtgttcacctaagaccctggccttaggatcatgaacgacaccctgcaacaatccggcttgcagggaataagtggttggaacggcttgggcgggctgaggttgaaaactcgtgtgtgctagccctagtggttgcaaaacacgcgcagtgataatcggctgaatggccgcgccaagaatgcgttcgatgacttggcccatgataatcaaacctaaatccgtataaaccacccgatggttgcgattacgtgaactaattggcaaccgctgaatcgcggctaatagtgcatccgctgacaacgcgtttcgattcggaatatagccactcagaccacttgtatgggtcattaaattacgactcgtaatcgttgtcgatcgtaaggtcgttagatagtcatgcacggggcggtcgatttcaagctggccatcgtgcatcagctgtagcgccacggtagtcgttcctacgaccttagtaaccgaggccagatcatacatggcatccggccataacggcttaatcgccggtttaacttgagcgactcccacttgttcgatatggcattcagccccatcgatcaaggcataactcgcccctggaatcacccggtcttggaccatttggttaattagtgcttcagttctgttgaaagttgccattaatttattcattctctcttattaggatcatgattcaagttggggatgccagtggtcaaatcaactgcaaggtcgcttccgggtaaaacgacacgaaccccccggctaactgggtttcactctaatcatggcgacgttgataaatgaccagttccgtcaatgaaccaagactaactgaatggtagccatacctgataatgaaccgactttcagtttataaccgttgaatatgactgatcgtacaatccaatcagtgctgacttttgaacaaccgcggtaacgtgaccaaccagtagctgatcaaggcaaccccgccaatgacgaggagccattgattcggcacaaactggtgattatacaataacgtacaccccaccaaaatcgccgtactgatccattcaattgtctgccaatgttgattactccactttatcatgttacccaactccccttaattttagcgttttttcagcagctcttacatcacaattagcaatcttaaactaaccgtaacgtccccttagctgaagaacggttgcttccatcttaacacctactggtcaaggcgtatccttaccattcacaataccacgtggcacttgagtgcgcacataaaaacgactttagtcctgctcgcatcacgagccttactaaagccgtcttctaattcacacgatcaacgccgtgcttagtctaattcaaccttctgaacccaaccttcaggcgcttcccggtcgccaaattgaatcccagttaattcgtcatataatttcttcgttaccgggccaacttccgtttcactgtaaaatacgtgtaacttgccttgatgttccaagccaccgattggtgaaatcacagcagccgtcccacaagccccagcttcagcaaaccggtctagatcatcaatgtagacgtcaccttgttcggtcttcattccaaatttatgttctgctaagtaaagtaatgaatacttcgtcacagaaggcaaaattgatggtgatttcggtgtcacaaaagtgccatccttcgtaatcccgaagaagttcgctgacccaacttcttcaatcttgcgatgttcaaccggatcaagataaacacagtcggagaaaccgttagcatgcgcctcttggcctgggaataaactagccgcataattcccaccgactttataagccccggttcccttatgggccgcacgatcatattcagacgtcgtaaagttggttggcgtcatcccgcctttaaaatagctaccaaccggcattgcaaagacggtgaagatgtattcctgggccggatggacaccgatgttaccgccaaccccaatcatcaatgggcgtaaatataaggttgcgccagtaccatacggtggcacgtaatcttgattagccttaacaacttgcttaacggcatccacaaacatatccgttggcacttgtggcattaataaccgttcgcaactggtctgcattcgggctgcattacgatctggccggaataattgaacactaccgtccttagtgcggtaagcttttaagccttcaaaatcttgttgaccatagtgtaatgccgttgagccttcactgatatgtaaagttgcatctcccgttaattcttttttataccaagcgccatctttccaatacgcacgataacggtagggaagattccgatattcaaaccccaagttgttccagtctaattgtacgtctgccatatgcttcgacttccttcatatgtaatttttcaaattaattaatttgaatttaattaaaagattaatggttaattagaagtttgtcaaggggccgttaaacatttccaacgttttaatgtttttttggtataatgagtgtaaatttagcaaaggactggtttgtcgtggctagtaattcagattcaatctataatgtcatgttctatatcacccatcacccgactgaaatacagtttacccaaccggaatacacgaatgtcgtccggatgggtgtccccgaccatatcaaggtcgctaaccccgaaatctattttcccgacaacaagcttttagtcaatcggtttcaggatgactttgtcgctaagaacggcaacttacttgatttcttctttgattatacggagaaaaaagtcccgaactaccatgaagtatgggtctcttcggctcatttaccggctaaacacttatacttcttggagttgtcatttgagtaaatttaatgggcaatttgggaatcaagcctaaaatctgcccataaaaaaatcaccatccctggattattcgagggatggtgatttttcgcttacgctgatagacgtgcaccgtactgcactacttagtcataaaaatatacaagtcagaggtggagacaccgattgtgaagcgaacccctttcgagttaatcggatcgattgttgtcgtactaccactattatccttggtttccttctggaacgctttcatgaccttcttggcattggcacccgtcgttgtcgtcattaaagcaaacgccgtaccaaagttattttggcgggtcttgttcttaaaggccttggttggcacaatcatcgctgcccccaagacgtcacccttctgaacatttagccggatcttataatccttagttgttaacacgttcgtgatgccatcacttggcgtcttagtcggtaacaattgcgatttgacctgcttcttagccgtggccatggctgcttcgacctgcttttgagtcgtttgcaaactagctgctttggtcttgagctgcgccgcagcagtttgttgggcttggagtgtcttagcacccgtggccgccgccgtaccgccagctttgatctgggcctgggcttgcttgactttggcttggatcgttgcttgttgctttttaagggccgcaccctcagtttgcaacttcttagccgcctgttgatcagacttgctgagtttagaagcaatcagcgcctggttataagtcgtcgccatcttttgatagcccactaatttcttagcaccctttacgtgcaccgtcgtagtatctgaaccggccttaatcttcaccgtttggcgggtcgtcttggtcggaacttgaatcacaaacgtatgattatgcaccgtcgccgtcttcgtttgaccaccgtcaagctggtaatgaaccttcttaacgttggacttacctttaacggctgctactaacccgttcggcttgtacgtggttttagtcgttgataacgttgtcttaccgcaaccggctaataataatgttagcgcacccgcagtaacggcaaccattgctgttttccggaacaattgacacccctcctttagtcgagactaatattgccagtaaattgactgttatacagatccgcatagaacccattttgagccatcaactgttcatgcgtcccagtttcaaccactgacccatggttcatcacaataatgttgtccgcaccttgaatcgttgataaccggtgcgcaaccacaaaactggtccggttcttcaggagtcgttccatggcgtgctgaatatgcacttcagtccgcgtatcaactgaactcgttgcttcatccaaaatcagaatttctgggttagcgacaaacgcccgggcaatcgtcaataattggcgttgtccttgtgaaatgtttgaagcttcttcattcagaaccgtctgataaccatctggcaatttacgaacaaagctatccacatgggccgctttagccgcagcgtagatttcttcatcagacgcatcctcgcgaccatacttcaagttgtcgaaaatcgtcccagtgaagagccaggtatcttgaagcaccatcgcaaagtgtgaccgcaagtcttcacgatccaggtcccgggtatcggtccctttcaatttaattgaaccacctttgatatcataaaaacgttccaacaaattaatgatggtcgtcttacccgcaccagtcggtccaacgatggccacttgttgcccacgcttaacgtccagattataatccttcattaatagatcgttatccgtatagccaaattgaacgtgttgcaaactaatcaagttatcgctatcggtttcggctggtaagttggacttcgtctgcttcatttcttcttcatcaagcacttcaaagacacgttctgcggaagcgacggttgattgaatcgtgttcaacaagttcgccatttgtgaaatcggttgtgaaaattgttgcgtgtattgcaagaacgcttgaatgttccctaacgaaacgttcccgttcgccacatcgatcccaccaatgatggctacaaagacgtagccaatattatttaagaacatcatcagtggcatgataatccccgaaataaattgggccttccaggctgattgataataattgttattttggacttcaaaatcatcgatagcatcttgttccttgttgaaactcttgatgaccacgtggccagcatagttttcttcgacttggttattcaacaaccccaagcttttttgctgagttccgaagaatttctgtgatttaggtgcgatcacaccaactactacgacactcagtggaatggtaacaagcgcaatcaaggtcagcttccaactaatggtcagcatcatccatagggtcccgacaaaggtgacagtacttgtcaccgcctgggtcaagttttgctgcaacgtgttggcaatgttatccatatcattgacagcccgactcataatatccccattcgaatgggtatcataatatgaaatcggcaccttttgcatcttacccttgaatgaccgccgtaatttataaacggttcgttgagaaatccgcgtcataatatactgttgaataaagttgaacagtgctgaggccaagtacatgatcaaaacgatcataataatctgaccgattttttcaaagttgattgggtaaccggattgactgataccagccttctgttgcgcggcccccttcataatccccttataaagctcggtcgttgctttccctaaaatcttaggtgtttgaatctggaaaatcacggaagcaatggcaaaaatcatgaccactgccaaaccgacccaccggtctgacatgtagcgcatcaatcgaatcgccgttttccaaaaactcttaggcttttcaactagtccagcatgaccaccggggccgtgaccgccagcaggacgtgcaggcttagtagaactcgtattcttttcgctcattacaactgatcctcctctcgtaattgtgacttcataatttcttgataaacttcattattcgctttcagttcagcgtgggtccccttgccgactaacttaccgttatctagaaccaagatcagatcagcatccgccaccgtggcaattcgttgcgccacaatgacaacgacactctgttgaatctgtttgtcttgtcgtaattcagcccgcagttgcgcatcggtcttgaaatccaatgcagagaaagaatcgtcgaacacatacgcggaagcgtgtttgacaagtgcacgagcaatcgctaatcgttgccgttgaccaccagagaagttacccccaccttgttcaacgtgtgcatccaggccgccttcttctttaacgaagtcagttgaacgagcaatttctaacgcatgccagatttcatcatcggtcgcgtgttcgttaccgaattgcatattttcacgaatcgtccctgtaaacagagttgcagtttgtggaacgaacgaaaccgcttgatgtaaatcagctaattgcaactgccgaacatcttgcccatctaacttgacggcaccactttcaatgtcataaaagcgaggaatcaagttaacaagggtcgtcttaccggaacccgtcccaccaatgatggccacggtttgtcccgaatgcgccttgaaattaatatccgccagtgccaactgttccgcactttgatagcgatagttgacgtggtcaaattctaggctatgttcagtggttgctggtaacgtagcagccttatcaggattcgtaatcttaggttcaatgtccaaaacttctttaatccgggaagcagaagccgccgcccgtggaataaatgcaaacaccatggccaacatcatgaagctcattaatacttgcatcgcgtaagtcataaaggcaatcatgttcccaacttgcatcgtttgactgctgatcaactgaccaccaaaccaaacgatcgccacgttcgtcccactcatgatcagcgtcatgaccgggtaagccaaggccacgatcgtgttaaccttgattgcattttttgtatagtcttggttcgcatcttcaaaacggtcttgttcgaacttgtcttggcggaacgcccgaataacccgtacccccgtcaatccttcacggaaaacaaggttgatgcggtcggtcttggtttgcatcgcccggaacagcggaattgcaaacgccatgatcaagccgataaaaatcagcaataccggaatggaaaccacaaagatccatgttaattcatgactcttggtatatgccaaaaagcttgcaccaatcagcatgattggtgccataatcatcatccgtaacgccatcatggccacgttttgaatctggaccacgtcattggtcgttcgtgtgattagtgaagacgtctcgaccttatcaaattcatcatttgaaaagttgatgaccttcttataaatatccgaccgcaaattcttccctaattgttgtgatgaccgcgccgctaaaaagacgttgccaaacgcagcgacgaccgataacaatgaaaatccaatcatttcaaacccgattttccagatataactgatgtcaccagtagccaccccgttattcacaatattagatgtcaaactaggtagatttaaggtcgcaatcacttgtacgatcataaataagaccgcaccaatcaccgcgggatacgaaatccgaccctttgctattttaagcatttgcacgctccccttcattcattattacataataatgcagtatattaatctaactaaaaacagtccttttgtcaaccatctttacaagtctcacgtaaaatattgtaacgcactcatcgcagtttagcactcaaaaggatttaagaatttattaaggtcgccctcgtgaccacaaaaaaaaaaacgccgtgtcatccaacgatgacacagcgctgtattttgctttaagctaatactttttgaatatctgcgggcacttgatgcgtctcaacagcttcccatgagttcacgttttgtcccttcgtctcaatcttcaagtagtgtccttgcttgagtcgatggtcggccgtaaacgtcagccagcgttgttttccctgtgcatcgctagtcaacatccggtacgtatagacatcttcccccatctgaccagtcgagtggctgatggcccgagtggtccgaccatagaccgtctgtaccttgacgaagggattcaaattatccaccgccatggcgaactcactgccctgattcttcgtcatcgtcggtacaacgaacgatacgcctacactaaccataataataactgccaacaacccgataatcccttttttcttcataacccctattccccctaattaattattttatttatcgtatcggagcaaagctctcatggctaccctaactaaggtttcttaatcgttttaagtgattactaatcaaatttggggttccttaaacattaagaaagttattttaacaatacttcagtaattatcgcgcttggtgtgctaatctattagaataggaagtagttattaatcatggggggattatcatgcacatccggggtagcatttatatcctatgtcttggcgccgttctcggcctactagcaggctgtcaggcggcctcaccgacacctaagcaagctagcagtcaatcatccaaggccagcgttaaaagcgtgcatagctcggctaagcgccaatcacatgcacggccgtatcaaggttggcactccgtcaaagtcgttcacttgccaatcttgatgtaccacagtatttctagtgggaaccagttacgcgttcccgccaaggagtttcaaactgaaatggcctatctaaagacacacggctaccgaaccttgaccgccaatgaggccgtttatgcgctcaagaatcggcggattccacaaaaaaaaatcgtctggatcacactcgacgatagttacaaagacaacatgacggcagcgtggccaatcttgaaacagacacaccaacacgccactattaatttcattaccggctttactcataaaaagaatcacttaacgttggctgatgctaagcggatgcaagcgtccggcaatatcgattttcagagtcacaccgttcgccatctggatttaaataatttaacttaccaggtccaacttacggaattatcaagttccaaaaaatggctcgatcataatttacagcaaaatacgcaagtcatctgttatccagctggccgtgctaaccagcagaccattcgagcggataagcaggccggctaccagtacgccctatccacggctcctggtatcgccaccagcacgcaaagtccgtacaacctcacccgacaacgggtcgtccctggaatgtcgctaacggcctttcaggcactgttaacgactaacaattaattcagtcgcacatacgggaaacttgagccaaagtgtctcttcataagtggtaaaaagtgcggttgcgataacaaccatcgaaacatctgatttacgcttcagctttgccataaccgtaaaataaagcgtcagaatgctgatataatcgcattctgacgctttattttgatctgtcgacgtcgacttatcacccgcacggtagttataccattaagggtagcacgctataaatgccatttataagccatttctgaaaaagagagatttttaatttacaaatcgtggaaggctcccaaatattttatattttgcatctctatttgtacatatttataatataatagtttatataatttaaacaaaaaggaaaaacaattggttttgatatttttattggagggcatctcatgtttggatggattgttttaattgtattttctattgcggcttggttattatgggaatcagataaaaatggttgggctttgatgagtctcattggtgtaattgtagggataatgatgatatttagtattggaccgtttaaatggcccggttataccaatcctgaacaagcaattaattttgcagccaagagagatcaatttaatatcacattgtataccgttgatgatgtgggtggtgcaggccctactgcgggtaatgcaatatatattttagagaacacacaaaaaaagggtatgtatttaaacacgatggcaaatatttttacttacttgaaagggtaacgtatattgacaacgtaaatgatcctacaagtaaatactcatatgcagttgatgcaattcctgtagatcagaagggggatataccgggagattatagaagtgtaaacattcaagaatatacaggagggcatgcaaaagaggctgtcgggttaaaatactcagatctcccattttaacacaaatttcatacccggccgaaatttctcttttttcttgattttctactacccgagaactatctgtctatgcccacgcctgccccgcgtgagcatttttttgtaaaaaaatagcccgtaccagccgaagccagtacgggtatagtttaaccaataaatagtttgttactaggaaaaaacatacgtaataagatgtggcctgatgacgttacattaaaaaattgacatctatgccttatttttatatcaagtttggcataacttgtaccaaaattgtgttgttaaaaatgaagctcgctcacaactaaaccagtactacacttaagcatataaatagtgtctatttagtctaaataccccataatttcaactatactatcaatatcaacaaacaagggatatgtgtcaggtatcatcattgtctgcttgtcatcatagtcatagtgtaaatatctaaaattataacgcgtataaaattccaaggcatctggcagcgatcccactactatccctataaggccgaaattaaaaaggtgtctcattttaattacatttttgaatatatcaagaatcatgcttgcacccacatgcatatcctgatactttttagcaactccgaaccacgaaatctcaactgcaggtaatacaatactttgattattatcttccggaaggctgcgcaactcattaaacatccttctatcatacggtgtttttacctcaataatactggtagaaatcgtataataactaacaagttgtgtctcatcataataaaccgtagttgatcgtatattattactctcatcttctagggccttcgttttcaagtaattattgactagattattcccacaatcaaattcatttaatagatgatcatcagttagaccggaaatgttacttttgcgtatcaaatagtatcgttgcttttctcaaggaggtaaccgccctattgatgcctttacgccgtgaaatagtatcatgtcccatagtactaggcagtaagttactcattatatcgcgtaaatcattgtgttctgaagctgtaataacctgctttaaacttttcctatcattcacaacagccatagttattcctccctcttatcgataacttttcattaattatagtggattttcgctgactttgtaaagcattattatcttgctctgacataaacttacatatttgaattagctaactcttaatttatagctgggataaatcgtggaatcaatagtctttccatttaatttaactagcgtattcatccccatagagaatcgctgggcaattacccaccatgaataccacccgctaattgccagtaatgtagtttcacagtagtgagtattaaagttgcacgatttctcatgtattcctatgataataatggaacctagtaataatctggttttctctttcgctaagatactttttcttatgtattagccgtctgccctcacagcaggtggctttttacgcaaaaaattccccacgccgaagcgcaggggaattaatcaagttataactatcatctagaaactacactagagacaattaatattatacttattacttgctattctgtaaagtattgtagttatctaattagctatattgacagctaataatgctaaatctaaactctcactaacaaaatatacaggcaagcaacacaaaaaaatcttccacccatcaagcagaagattatcctcatcacttccggcaccactaaccgacaatcttggagggatttgaaagctgtgatactaataacaggacaagggacataataatacttgtcggtttatatcacaataccgaaagtaatctatagaaaaatattaataagtccttgttatattaatcaggtttaatgtataataactgtgttctttattatcttaggagaaacagaacacccattttatttatttaaacattgggccagtcttgactggctcttttttatatattttgttaacaaaaaatcccccacgccgaagcatgggggactagaacagttcacgattattatactactttttctcctgattgtgaggcggattctgacgtcgtttcagtgttagatgatgcagaactattcactgcagcgactgtggacgttggtgcttgtaattcgtcagcggtctgattagtggtcgcttcaatctggctttcctcgtcacttttaactgttggtactgtcactgtttgaacgtcagtaataacgcccagcataccaaggatcgttaatacagtattaataacggcgacaatggctgaccagtcaccagtaaacttaatgccaaacatggcaaagatttgttgaatcaaaacgatcagtaacgaaataatcccagcaatcaacttaccatttaaacttccgtcggcattcttaaaactaatttttttcatttcctttggcttccttttcatatagatgtttaaattcaatgtcatgaccatctaaccggccttctaccttaatgacccgattttcaatcgcgttcattgcgtcagcgttttgctgtcgtacttttaagctttcattggtaaatcggctaagccgctttcctaaatcgttaagtgggatgcggaccgttttatttaaaatccagttagctaacacacaaacactagtgacaatggcaacaatggatccccattcatcccaacctaatcctaatagtgtatgcaattaccgcaccaccaatcgctgaccaggatagatagtggtgtaaatcgtcttgccgttctgactagctaatgtagttatacttaggccgttgcgctgagcgattgaccaccagctgtcgccagacttgactgtgtaatacgtatgagttgcaccactctttacgtattccagcgtattgcttgccgggccggttgctagataaccataaccattaaatcgtggctgacgtacccagcgataaccattctgaatgatagcttggtcagttttgaccgtagtcccagctggcaagatagcaatcacacttgatgccgttgacgtgccagtgcgcagcttaaccgccgtcttgagcgtatagttttttgactccttgacccacttgaccgaattagatggcttggaagtgtttttgttggcctcctggttgttatcattaacggcatctggatcggttggcttgacagttgatttctgaccagctgtgtagtaatcagtataaagttgactgacgtcaaagccaccgtagctaatccggaaacgagctgccccggaccattgccaggcattgttattcgtataccacttctgaccagacatgacataggggtaaccagcaacccaacctgttttgcccttgatggtcatcttgttgttagcccatgatccagacgtataaatgtcggcccgataaccaaacttctgaatctctttcatgaaggcagcattgttgcggtcgttggccgcttgtgacaagattccttgttcctcagccgattctacgtccgttgccaatactgcgcccactggtagtctggccgctttggctgcctgaccagcaaagtcagcttcggcaattgcttgagccttagttttataatgggcaaagtgatagccgttgacgtataagccagctgcttgaccattagcgatattgctagcagcatagccatctttgaaggttgtaccttcactaatctttacggtaagggccttaacaccaaattcattacgcatcgaaacatactctgtcgttgacatgtagccgttgttattagacacatcgaccatatccatacgagcagcctgactggtaacgttgatcattaaaaaggccataaaaatggcgcccatcattaagatgagtgcctttaatttacgtttattcaattgtctacctcctatttgtcattcctgattgaacggtcaaaagcatcctaaaatacactggcctagtcgttttaacttattaattttcaattcaccatctcttcaaagttcatctttcacttaatatttatgatgttggcaattcattcttaagaatggattgcagcacgctctgcgcctccgacattgtaacatcgtctaacttcttatctgaaaaatctgattcagtggcagtaacattcgcattcacatatgtgccagtttcagactgattaaattgagtggatacagatgaaatcctgccagcagtaaaactccacccaccattaactgcaattagagagtcaattattgatggaatcttattcatcgcacgtttggataattctttttttgttagatcatcgaaagtttcatctttagctaagtctgtcggataaatagtgacatttgccgtaatagttactcgaccttctacttcgccacgaagacctgcaattacagaactcgtatttccagttccatcgatattataagagatgctagtgtttaatagttccatttttattccccttttccatatgctttatcaaactgttcaaatactaatgcgtatactaaagctgtttgcccttccagctcatacgggtaatcctcaagtgcattaaataaagctttcattcgtgcagaatatgagctaatttcaatacttactggttcttctactaattggtcaaactctttttgagcttcttccatagtatatccatctttaagaataagcgtctttttgtcttccttatagacaaattccccatcttcatcggttttaaaaaagttcttttgcgttgctaattggtcagcattaaactgcttgttcaggtcctcaagtcgattaattaaccatgtccgcccgagagaagctcgacctttaagcttaaactctgccatagtgtttccaattgatactagttgcccatttttgaatgttaatacttcttttcttgctgtcataattgactatacctctttcgtttgtttgattttgttttccaatacagttatgcgatctcgatagttacgaattaatggaataagagccaatgctacccggtcatactgaataccattgacctcccctttatcatcgtactcaacaagttcattcagaccagcatcatccagatcatcagcaatcattccgaaataagtttctggatctttagcattagaatcacgagttttggctaatacttcttctttgtctttccaatgcgcaactggaacttctaggagtttgtcccccatttcagtttcaaacgatcgaacgatgtctgttttgtatttagcggcggaggttgacggaactaatgcaccgtctggtgccagatatgcgtttgcaccatgagatgttgtatgggtactctttagataaatataactagcctgcatactaatgttagaaccatgcaaaccggtgcctgcgtgaccaggatcaccaactcttatatacggtgatagtcttatgccatcagtgaatacgcgaccaccagatataagcacaccccgttcggcgccaccaatcttagttacttgccatcctgaggtcgagtgtcctccagaaatacctgcgaacttttcttctcccattggcgaagtaaagatatttccatcgttagctccgttagtgaccacaaaatagtcacgtccccagaaagttgcaccaccccaagatgctcccgcctgagcattactgatacgaacatacggcgtagattgacttgagaataatgtcggctggatcatttggatttccccaccagatataaacacacgattatccctgtcagcgactgagatatacttgttattgatgttgatatcaatcgcattatcagatgaatggatacgtcctgcctggaactcaacattacccgtgttcagattaatcgataagttactacctttaatcgtaccggttgttatgttgttcgcattcaaattgattacattgatatgcgcagcattaatagtacctgcagtgattttatcggcacttaggttctcaatcatggaattcttaattactgcatcatcaatataggtagtagccgtaatatgcagcttgttaccgtatatctggattccttcagtcgagatattaattgcgttaataaccccggccttttcaacacgaagattgatccggtcattagtttgattgatagcagaatatgcatgctgaaggtcttcgccagttgtaacatcaggaacataggtagcagcagtggttccttggttgagcattgggcatatcatagcaacatggccaccaccatgaacttggaatgcaaggcaaactgtttcagttccagccggaggaacagcattttcaactttaattagttccattccacggctggttttatacgtttccttaagcccaatacgattacccttagtgtcgtaaaattcaatagtaattaccgcagcgaggccaacggtatcgatattcacataagcactagccgaccaaggagtcgagatatcttgtccaataacaattcttctagagtgcaaagcataccagacactattgtcagtcgtcgttggttgattgaagcaaataccttgatacccattaacccatgaccaagcaaaatctgatttgtaccacatatcagtagtcgcaccagttgtagtccaagatggtccgcttagatagtcgtattggaactgtgagttagtcacaatatttcttgaaccaaaggtattgacctgccctacaacagaagttatctggttacttaattgatctaccttggactgataggtactgccatcaacttttccactaacagtcgtttggatgctgttaatagtttgagagatacttgaaactgcatcaactgttgcgttgtccaatggattggtggaatagtccgtagcatttgaacctagctctaatttcatatcggagaatgtaatagtagctgtcgaaggcacattatctaagcggagataagcaccttgctgtgaatagccatctaacttgattgttgctacataatgcttctttgtggtaccaacggccgcattattaaggtagcccatccaagtcccaccgtctccgctagcactattttggattgtaaagttcgcagaagccgtagaaatggcatcaaaacttagagttactgtcgttcctttttcgagtcttctgcttagtgcgtacattagtgtcgcctggttaaccccaccattacccgtcataatgaatgggttataggttttcaataacaggttagttcccacagcactatctatcacctgttgctgaacagtcaacaaagtgctattaaatgctgtagcactcgcttgcaattgactaatatcatgcttattagtgttattgtcggtgctcaaagaatcaaagctagcaactaaagatttattcgttgcctggagcgtaccaatatcagtagtgtgcttaccgatagtattgttgacagtcgtaaattgagttttaaacccattcgaatcagtttgcaaggtattaatactagttgtatgactgtcaacagtacccttaacactcgataacgttccgttaataccgttcgcagttatgctaatttgattgttagtccaatcctgtgtggcatatccattaagatcagttcgctcaatcttcttggatatatcagtcttcataccatctacagtttgtgaaagcttggagaaagctgtgacggtagcattgtcagcaggattagggcaccaatcagtagctaggttacctttttccaactttgggtgatgataagtcgttgtgacatcgaccccaggaacaattccagcatgtccggcgtataataaaaggtgatagttgtgagagtcatttggaattgtaagagtaacactatgccgttcgccatcagcggggaatgcatatactccaacttgcgtgttagtgctagattcccatacacgtattgatgcctccgctatcttatcagtactattcttagcttctgctgagaatgtgtacgtttttccgtgctcaaaagagaagcctgtatcaatattcacccatccaggccaaccatcagttgtatgtgaagtgatactgatgtccttatcggttccggtaaggagattagtcccaacagcgctatcttgaacctgcgtttgaacagtttctaaagtactgctgacctccgttgcagtctgcttcaactggctgatatcattcttattagtcgtattatccgtctttaacgtattaaaaccagtggtcaattcttgagacgatgcttgcaaggtagtaatgtcggtagtttgcttaccaagagtattattaacagttgtaaactggctcttaaatgaacttgagtcagccttgagatcattaatgctagttgtctggccatcaactgtgctcttaacactggacaaggtagcattaattccgtcagcagtaactttaatctgattttgagcccacgtctgagtggcatagccattaagatcagtcttagtaagtttggcagctaggccattttgtaattcagcaatggtcatagttgatccgtctgttaacgtcttataactctgactaactgctccagcaatttgcttagcatctttggaatcagcggctgcggacgttgcttggacaaccgcagcactagcatcactttgagcattcatagcactggataaggcattgccagcattttcttcaactttaccaaatcccgaagctgttgattcagctttagcaactgcagaactagcgtcattttgagcattcagtgcactagctaaggcgctctctgtcttttgattaacttttccgaattccgaggctgtagagtttgctgtagcaactgcgatactagcgtcgctttgagcgcctactgctcgatccaatgcttgattagctaatgcatttgtatcatcgtacttggccgcaagctggtcagctttatcactggccactttagcttcatctgtactagccttagcttccagttccacttggtcaacttttgctttcacttcttccccagtagcgtccgacacagtaagtacccatttaccagttccatctgcctgacgctcgtaagtccacaattcaactttattaccgttctgcttgtaccagatatcgttaaatttagctccgtatggcggttcagttgtatctgtaccatagatatagttacccgaagcaccttgccgtccacctaagtcagcaacatattgtgatagctcgcctcgccaagcatagctactactagaggttgaggtctgatctgctttagaaacagcagacaaactgccatcaaacgtcatagtataaccattattaggcacgttgaacttgttccctttagtatcctgtagtgttagccaatcgccagcttctattgcaggattgccaaaccaattcaaactgaaagggtagaaggtcaagctctgtaactgttgccatattgatgttaagcgatccattgtcatcaaattgttggtgagtttaatctgtgatcctgacgctgcccctacttgaagcgtgtttgtagtttcggtactctgacctgttgaatccgtagtagtcgttgtgacctcacactgaataccgccaattttgtatggtgcttcatttttcgttaagccaccttgttcgtattggctcgggtctaatgtataatctggctctgcaatcgttcgaattgttaatttgccgtccctatcaaacgttacaaatcctgcataaaattgagcaatcataccaattgcatttcgatacgtttgaccggtaatagcactcggtaagtcaacttgtacaggcaaacgaccaatgtcagttgtattaagcaaaacgccagccaaatttgcaatttctgcaatcacactggtcattttcgcagggtaagttaacttagaagtgtaggtaccctccaatagacacatctggtcatatgccttaattgttgtctcatcgttgtttcggtccatttgaatgtcatctgatacgataaaaagaccaagcgagctatactcatagccattagatgtttttataccaatcttaggccataccgtcatgccgggtttaagtccttcaattaagtgcgaaaacttaattgtcacgctgttttcataattcgagccaataccaaacgtatctccagtatagccacctgcgtcatatgaaatggatgcaatatctgtcgttttatagtcaatcttgttaattgtgacaactgcatccaacgtccgttcagttgccttccatgcagcgagggctaaatcagattgcttaatcattaattttcacccgcctactgttcaatgaaatccattgaaacattctgccaaatataatctgatgtcaatggattaagtgtataagtcggtgcagtccgatcaccaacataaaatgtcttggtcactactgcaccttcttgtgggtctaaataactgcaagaaaaaaactgtccagagacagcttttagtattgtactattctcagccaatgttagcggcccccattttaccgttagcttgcgtttgattgcgacacggtctcgatgcaaaagcccattcgcgtcacgtgatgcttttgcatcaatatcttggattgcaacttctagggactgtggtgctttaaccactgtcccaccaatcttcagtgaatatgtcaatcgtaatcatctcctatagtctcaacatgtttttaccattcttctgatttaccgcgttaatgcctttaatagcagcattaccgaacttctcatcaccaacttgcaacgtcaagttcacattgatcggttgattgttcatgctgccgccaacgtttgtcatttgtaagccctgtacaatcgcgttaacgatgcttgttccaagctcgttaatgccaccactattcatactctgtgtactcgtactacttggctgactagccagactgctcatatccatcgactgagttaaagctgcgggcatttgtaagccatcactgaacgtttgtcccatgaagcttagtgcctgcttaatcaattgcattgaccgtggaatgttagttaaaggtaaaaccatttccggcttattctgttcagccacttcgatcatttgatgagtatcaacaagaccgccgttagcaaaacggcggtgcccaatcggtccactgtgcaaccaatcaaatttaggcgtgccccaaatgactgtatgaccagcagcattgtaatagtctgagttattcagataagccaatacttggtcaaatgatgatctgaaattatgatgtccaggaaaagcaaatgcatcaaaggttgacttgacatactgtagtggtccacctgcaggattaccagctagcgagttcacatcagtaattgtctgcgtaatatttcgattcccggtctctgacttagccacttcaatgatatcgtgttgcatctttgaccaccgcgatttaggaactttagtcatctcgagtgcgcgactaatcattgaatgagtgattgcaccaccatttggtccttcgctctcgccgtattctttgagaatcttaccgacccaacttttagcactatcaacactaaaatccaccatacttttagcaacatctagcggatagccacctaagccggtaaatttaacaaacttgttcatagtagctttcaatactttttcagggtgcgtgatatcgtcccaaatatcacttgccgtatctttcacaccatcggcaaaactgcctacactgtcccctataccactgaacaaatcaccaaaattcggcatgctaaagttgaaacttggcaaattgaagttaccaatacttgaaaagtcaaaatcaaagtctccaataccaccggcatagtgtggcaccattgttgttgctttacgagccgtttgtgccgcattgagaatttgagtacctctcggaagattgaccatcatattgcgaactgctgggaaaagacctgttcgtccatttggtaacttgtatgcttcacgatacttatcaccaacctgatcattaacgattgctggaccacctttatggcgaccaccagttgcaaatgacggaacactccagtggctcaatgactttgctttgctggaggcgcctacgtgattgagaatccatttaatgccatcgataacgccattaacggcttttccaatcgtaccaataattgcattagcaacatccgcagaacccttttttacagacttccaaccagatgaaagaccgccaccaattttaccgcctaaaccaccggcccattttgcaattgttttacccgtgccagttctaaacgaggcaacccaattacctaaccgagtaccggctcttaacgcagccgtcctagaactccccattccagaattagtcttagtgcctaaacttccagcccaactagagacagtcttacttgcgccagttctaaagttattaacccatgaacctaacttactacccgcattcttggctaatcgtttgccatcttcaactttagtattaacattactaccaatatttgatgcccattttcgaataccgacgattgcacctttagatttgctcgtaaactcagacgtccagttaccaatctttttacccgcttcttgagcagcctttttaccatcagagactttcttgtgaacaccgttgccaatattcgatgcccaagcgttaacagttctcttagcaccgccaacaaacccagtagtccaattaccaatattctttcctgcttgttggaaatccttcttagcattagttatatgggttccaacctttttaccaacactcttagcccaatcggaggctttacccggtaatttcgatgcccatttaagaatattcttacctgtttttgtatctttaaggaaccaggaagcaatcgtgccaaccggattaataataaaaccaattattttagtccaatttttagagatccaatcgattgaatctccaaaccatttggttatattcttccacacagaattacaaaaatctctaaatttcttgttatgcttgtagagtaatacaaagccagcaactaaagcggcaattgcgctaataacaagcacaatcggattagcatccattactgcattaaatatggcttgtccagcagcggccagtttagaccacacagaccaactcttgagcgccttccaaccatctgctaatgcagtagcataatctgaccacttcatttttgcaagcgaccataatgtcttcacactgccaacggcttcttctaacttatcaattccagtaatacctttgaaaaagtctctgagaacatgccctttaccaccaataatagccgctttatcagctaatttcccaagtagtcctattccattgcttagccccgtcattgttactttaaatgcaaacatagttactaagactttcgccattgcttcaacggccgtatggtgtttatctacccaactggaaatcccgcctaatgcatctgctaacttcttaagcacgccaacgataactccaccagtccactttgctaatggcttaaggaacgaatcccatatccatttaaaggctggctgtgaagcttgaataatgctgtgaactaacttaagcgccgcagctaatgcatcgaagaacgttgggattaaattagtaatcgtgtatttggccaatggtaacaggatattctgatatccccaatccaaaccattccatacgtctttgactactggtctaatcgcttttagtaatctatcaatcgattgcagtaagggcgtaaagtcaagtttagaagcccacttaactgttgctcctgacatgtcatttaatgcacccaacatgtcattaaccataccgagcagcgttttaaaaatagatgtaccaacgccaccatgttgccaagccttatcaaattggctgccaagtgcactaacagtattaaagatgtttgtgaatatcttgtagagatttgatgcaattttctcacccgcaccactattccaagcattacgaaatgctactgcaatattattaagcacttttattacagcgttcaatgcatttaaaattgattgaataagcttggtaccagtgttgccatgattccatgcattatcaaacgccttagcgatatcaccaatcagaccgactaaatttgtcaccaacgtaatgagattggcaaaaatccgttcgcccagattgccgccattccatgcactacggaatgaagtggcaatatcatgtatcagtttcaatacattatttagcgaattaaaaatggtttggactagcttagtaccacgaccgccgccaccttcccatgcttgtgagaaagctttggcaatatcgccaataatattaagcatgtctgctaacaattgtaagatagcttctactgttttctgaccagtgccgttatcccatacatgcataaacgaccgaccaacatccccaagggcgcgtccgacctctttccaagcatacttagccgcatctactaccgacttacccttggcgtcccacgccgccttcattggatcaaaaagttcacccaaaactttttgtaacttttttgctgcatccgttgcgctattgaatgactgacctaacggaacaccaaaattaacaccatcattaccggcttcactaccaatgtcatccgtcgactgcaacggtgtactttctggtgcactttgcgtgggtgttgactctggcgcagcttgcatttcttgcggcgtaaatgtctctttaggctttttatcgtaggaatagtcttcatcatcgctactcttatccaagacattgagctcatcaaatcccattaaagactgcatgagttctttgttctttttcttggttgcttccatggaagcctgagaacgtttattggcggcttcaattgccgcgttagcagcacgaactttggcagcaccttgtttgttctactccgcaatttgtcgattagcctcacgaactgaggctgctttagcctgattttgcgcccgaatttgagcatttgcttcacgaactgatttagcctgagccgcattttgctttcgaatctcttcgtttgccttcttaacagaagcagaagctttgctagaagcggcagccgtgtcatttagtgccttagattgctcataaagtccctgagcgccttgccgcgccttggaatagctcatacccgttagtgctgatgtgaactgtgccaaccatgatgtcgctttagataatgacgacattaatgcattgacagccggaagtacaaagttgtaaatcggatagaatgctgtcagtaaattgaccttgatttgattcagactacttgcaaactgcgcgttcgtcttaaatgctgtcatcatcccagtagcaagttgcgtcaagccttggtacagcagaccaaatacgattaattgtgatgggaggtacttcaactgctgggcaatgccgcccagggccccgctggtccgtctagcactagaagaggctttgttcattgaagaactactactatttccaaaattgcgtatccgacttgttgcaccttgaataccgttgctaatgcgactgaaccaattagaaggccccttaccggaacctgatgctttattcattgcgctacttgccgcactgccgaaacgattatacgaacctgccgctcgtgtagcagccgtcccggattcacccatctcagtattgagcttaccaattacagatttaagttcgtcaccacgatcagaaacataagcatagctcttgttcagactatcattggaattaatgagcttgttcatcttatcgcgtgtgctcatgatgctcttttcaagtgccgtgctttgcttggtcagccggtcgctggcacccatcgtcttcatagaatcctgaacatcacgataggagtcctgcaacgccttcaactgacgccgataggtttcgattttaacttcattttgatccatagctttagaaatctgccgcagtgagtccggcaccgctttaaattcttgtcgcattgattgggctagagctttagcttggttttgataacgtgtcatctgagcttgagcggacgcaacctgattatcaattttaattccttgcgtcccattctgttgagcggtattcaaggacgttttttgattcattaagtcacgcatcttggcttgagcagctcgggcctgatccatctttgcattgatatcactcagcatggcctgtaagtcctgttttaccttaacccggctaccggtaaacatcttgccagcattctggttgaccttgctagccccggtagatgtcgagctactcattcgttcgaatgcagttttgatagtctcgttcaaaccggacaactggtcttgcaacttttgaacacctttagaaacatccatcgactgctcggtcttgtccataccggacttcgcactatcagctgtcttccccataaacttgtcaatcattggttgaaccttggcaaactgctgttccatttgctcagtgttcactttgaatagcatttcaatttcttcaagttccacgttattgccccctttctatgtagttttgttaaattctctagctgttttgattttttgcgattgctgcattagaagtaactggtcccgtttccattcaggaacagaatccgatgatgtcctagtcgccgttttgataaatggataagcctcttcaaccgatggcattttgctagggtcgttcaaagcaaatgccatcatctcagcttgcttgtgatccattaccgctctcatccgcatatcatctattcggttacgattatttgcgattacttgaaccatgagttcaccaaagtcaagttcccaaaaacggtcagaatcaatccctgattgcacggccaatgggtaaatagcacttagcaactcggaaaccgtctggtaattattgcttaaagtgtcgtctcggtcgttggttcgttgtccagagtgacttccgattccgtattcgtcttcgaagccgaagctgtcttgccgaaaaaaccagattcctggaacaagtctgttaacactgtaaataaatccattggggcatggccctcatcaaaatatttttcaaaggcagcaaaaatgtcgttatcagtaacgccgtgagtttggttcgcaccttgcaatacgataagcatttcattcaatggtggcaatttcattccgccatccgcactcataaagagcgacatcatagacttacccaagcgtttttcaatattcaaaatatcacggcctgttaactttaattcaagttgtaatccacccatttcaaacttcttagttgctttctttactgtcataacgtagttcctccatttttattattcgtctcatatcagccagctggcctactcgtctcttactcaagttaattattatctggataaaatgtgacggttctaagctccggcgctactactggccgttgcaaagtccggtccgtccgatacgataatcgaaatcgtgtattcaagtgctccgttgacagcaacgttacccattttgacggtatatgagccagtgaaagaagctgtcatcccatcaggataagtgaccttccatttatattgcttattgtcaccattgtgcgttaaagccgttgcaaagttgctacccttgtacacaaaggtaaaagctaacgttgatgtattttcaatcccaggaactgacttctttttcgtatctgataaatcagtcacatcaatattttctgggtctgaacccatgtcaggaacggtcttaataccgccaatttcatcaaacttagtgccatccactgacatttcaagcttggtccctgttccggcaagcccggcactagcgtctgcagcaaatcgttgtaaatcaaatactgttaaattctttttcaatttcaatcatcctttcaactttcaaatacgcggtgactagtgttatcaacaacaccagtaaatcgtaatacagtgcgattcacacccgctaaattgctatcaccaacatcgcttgaaaagcccatatcactaaatgatgacatgagcttattcgtgattgccgttgtgctaccttcttttaagaagaggtcaattgtgatcgtccattccgtttgcaactcttgctgattagcatcacgaaaataggctttatgtgccgtgttgtatacagcgattgggaacaccgttaaattatctgggtacgtggttgagacctgtttaatttccggtatagcctttagtgcttgatacactactgacttcacattaataattaccatcaactaccccctaatttgttatggagtgcggcctccacactctgcttaatcatctctggtgcctcacgactggcttgtttgacggcgggggttaaaaactggcgggcgggttgaccgcttgtccgatagaatgtgtgtccgtcgatttcgattttaggcataccatacagttcactcaggtcagtatcaacgtcatcagcaggaatgaaccaaggcgtttgcctgtacactggtgtaaatccatcgggtaaatctttttgcgactcctcacccactcgtccagtaccgagctcacgaaatagcgctactgggtcatcggaccagacacgaccgacaatcttgccatcactatcgacaacctcatatttaatacttcgagccaactcaccatttccatacttaacgctggattgaagttctttgactgcatagccctctgctttctcaacaacatcaaaagtagcatcccagatggcatcgtgaaccacactgggcatttttttgagctgagctttcagcttatcactgccacgccattcaacttcagccatcctattcgcctcgtttacgttgctctaaagtgatatttttatgggtgctgaatgtttgtatcgaattgataacgtaatctggctcgctatctttagtaacattgacacaaacaccccaattttcttgttgaccttcattgatctgattaccttgatacttaccagatttaatgtacttaaggtctttgccccagatttgcgcattcactgaaccgccagcagcttgaatgttcatcctcactgcaattggattgctccatcccgccgtaatgacattaccttcatcatcgtgacctgattgttgttgtcgtaaataaacagttgtcaggtctgttggtctaaggcgcattagaatcgcctcgttttcgcgactcggtaaggtgctagcgcggttttaattatgttaggtagtcccagttcaaacgattgagaaacgccgccttctgaccgcgatgcttcgccttctgttccttgctcgttgtacatgataatggcaagccgttttgcctgaattagaatcggtgtcgagagtgaagaccgggtataatccaagcacgtttgaacagcatcatcaaagatgtcatcaaccaccgcagcatccggcgtgtctttcttaacacctaatcgcgtatatagtcttgtcaattgtcccgccttatctggtgggcttggtttagccatacgatcatcctctattcttcgtcgtctgtttctaactgagcattatcggcagttttctcgtccttctgcttatcaagacaaacaaaaagctcatcattgaacgcgtcttgcgtaatgctgagctcatcaccttttttataccgagtatctttataccgaattgggtaatctttaacgcgaaccttcattatcaatcacctctaggctaaaacctgagcttgaaatacctcatccgccgcggcaaacgctggaagcgcaactgctgaggctttttcccaagtcccaattggatcattagtttcggtataaatcatatcgtaaacattacccacagcgttaatttgcgctgggccactgaattgtgctaactcttctggagttggtccaaacactttattaccaatcgggtcatcgttcattaagacaagtcgattttctgggaagtaacgactcttggtaatcttgccatcttttccgacttgggtatatttttgatcataagtccgaaaaattggtaaaccttgtgcctgcatgaaggtgtcaaagtcggcttgtccaagtgcccgagtagagttaccatacacggcttgtagaactttggtattagtcgtaatcaatcgataaatcttccgactagttagcgcccgggttggtgtaatatccatcttatcgcaccagcgcgtaatatcaccaaggatatccgcgtcgccgttatcccatgtagcagctccagtcaaagcttcctgatgttcagtcggaacttgataatcaagttggacagcaagtttaccactttcatctggcaaaatagtcttacctgttgctaaaacgtccatagcggtcttttcaattcgtgctaaaacgccttgattgagcacatcaaagtcgttataaacatgttgttgcaagtagctagcttctgcaggcgtccgcggattgagcatcgcatacaaatctttttctttaatctgcatcttgcgcttaatcaaagccagttcgatggcagcgcccgaggcagaccgactgccaatttcggcttcactatcaaaagccgcataggatgcaatcactggaattcgattttgacgtttcaagatatcaacagttagtgagttgactttgattgctgggaatagttcatcaccttgcatcgctggatactgccgattcaatgaaaaatcgattaaatcatgttgcgtgaataaatctgaaatttgagccatttgttttctcctcctttaattaggcttgtgatttggtggcggcgtccgtatcagtgaaagtaatcttctttaatgccgtgatagcctcagctgttggcgccactggtaagcgttggccaaataaatagccttcaacaatcacgccaaccatttgaggaccatgtgtaacgtccacttcattaatcgtgactccttccgccttagcgtcattagttggataaatcgtgccggctggaataactttatgtccaaaagcatccgtcttcaccgcgtaactggtgtcatcaacctgccgtgagaatgatacgaacttttcagatgacatgaaattcttttgttctactgttcctttatcaaatacataggccataatctagtacctccctattttgtcgcccataaactggactttgctggcttttgcgagttatttaatttttcagctgctgttgcaccttcagatttatttgcggatgtattagcacccggcaatgtggtcccactgcttgcgattcgcttatcgattgcttgctgtaaactctctgtaaatgccttgctgattgcagtgtaagccgcttcaatgcctttatcatctgctaaaacatcatcaccaaaagccgcaatcagtgctgtcggcaaatcgtctgcacccagtcgagccgtcactttggctttattttcaacaatagttccatgacgctgtgattcagcaagttgcttggttaattggtctttatcatagttggccttttccaggtcagtcatcttgtcgtaatctttttgctgctgagcttcactagcctgtttttcatcatgtgttttaattgccgaagcaatcagcttatcaacacttgattgccagtccttttcactagcaaacgatttaaacggcgtatctgcctgattgtcttggtcagagtcgtcattgttgctattttgattggcgtcggttgtgttaggcgtgctatcagccgtctgattgccaccttcatccccgccagttccattatcaccgtcagcaagcatctgtaaattcatctttagtttgagtagctttttcataattaaattcctccacgcccacgcatttccgataactcaggccacaaaaaaagcaccccgtgcattactctaagagccccacacattgtgctaaattgaccgtggcgtcattatcagacccacgcatgctatttagtttgagtagtttagagacgtgctcaggtcatccatgctaatcctgatggaacattgtcgaaaggatcatcgtggcggtttgtattgctgttacttgatcatatcctttattaagtgcttcctcataacatgttagaaatgcatccgtcatgagcttaaagccttgctccgtgtcagcgtcaaacgtcaagcccttcattgccatctcggtgtaacgcattaaatccgaattatctttactcatcgtgttctcctcgtcgtactaaaaaacgcccaatcaaaatgattgaacgccctacattgcaacaataacgatatcttgccattggtcacggattttcttgccatcaattacataatcaagaatctcatcaacgtcgtcagtatctttgaagtgataatcaaaatcaccattatctttagaaatgatacgtttgccctcactgtcaaagccaatgtaccactcaacatcattgattttgatttgaacctccatacgaacatctaacgcaaatcgaagttgctccaaagactctaagtgatccgaatcagcttttactcgtcttaccaccatctttattcacaatcctttctgcaatcgttaatttccgcccaggttcttcacgccggggaacaatcttgccatttttctttgtaacgcgtaaccagggatgcgcgtgtggcacaatcgtgtgcattttagcattaccatggtcggtaaaatcaatgtccagccgggcctttcctgtcttaccataatatcttcgtgtaactagttgtccatcgacataacggtcaaaaactgagttggcttcctgttgatacggaacaccgtgcacttcaccaaaattgtgtacattgttcaacgcaaattgttcgcgccgaacctcgcgcgctactttcaacaggttctgataactatcactgtcattatacttcatcgtttgaaaatcttcgaatgtttcgggtacattatctccacctaaaatccgtttgtattcatcatactgggtagtatcatatcgacgattgccaacccgattatctaaactatcgaaagcctgcggaccatgctttaagattactgcctggcgccaatcctgataagtagcatccggcttcagcttgagcttttcaccagtaattggatcattcgctgtccgttgcatcatgtactggctatctgacaaatagatgattgcgacagttcggcaaaatggatgtaacggcggaaaattaacattcacttccgcttcatctacgttaaatacacggccgtcaatactacgacagatttttgaagtccgcatatccagcacggcaaccagttggtactttttaaccccgcgtcgtttccattcattgagcttcgtttgattatgaaagtagttggcttctgttctaatcaatcgtcgcgtattgtaactgctagttccaaactccttagctaaagcttgtaccatgtcacgctcacgcataccactcatctgctgagccgtgaatagttcactgagtcggtcggctagttggtccgtgttatgccaaatccgtttagagtagttcttgcctttaaacggcgcatctaatatagccttaacgtacttccctgacaactctttaaaccgtgttattggttcgtctgggttcactttaactgttaccatctctttacccgttttagggtcaaagatagttctagtgtgcattttaggctgactatcagcgctcacgcccggaagaatgacgtctttatcaaagtcacctataatactctcgttagttgcctgatcaagtgcttcttgaattaccttggtataaaggttcgtggacttctcaatctcaacagatgccgcttgtttcaccgcaatgtagctcttagccttgagctcttccaatctggtaatacggcccttagctgccatctgtgataagtagttagtcacttgcttctttgactccttatcactgacattatcagccagggcccgtaacgttactaactcagtcggactaacattggtgtttaaaatctgttgtgcctcggcctccgtcgctttaccgtccgtaaaatatcgtttgtatatctgtgatacctcaccagtcaaatagttctgagcacgcatgtatgcccttgcaatgatagtcgcttgtttggttgcagcatcatgtgatttctgttcgctctgaacggctcgcagttgccagtaacttaacttgcgtttgtcatccgccactcctacacctccgagcttataaaatcaaatacagcaaaattaaaatgcctgtaattggcttccatccaagcgaaactaatccaagcattttaattatcacgatcacaaatacaccaatcgttttaatgattttattcaattctgagttaattacccttcaccaccacttgcaaattctgaggatattgtgctgaaatatcttgtagtccgtgtaataaggtctcacacagaactttgttatcagcactgggctcaatcaatctaataaacaagccaccattttctttaatagtggcgttagatagctcattagtgatggcttggccaagcaccgaaacagcagcacaaactaggtcatggcccttaatagcactattcgcgtggcccgttatctgataactcactacctgctttttgtttaattgaaacgttgccagaatcatccgcagttacctcctcgttatctgtggcaggctcgccgcccatagctttctgctgtagcttgagtgctttctccttttcctgatccagcatcttaattaactcttgtgggtcatttgtcccaggcaaccacccgagtgataccaattgcggaatgacaccttcagcattcttgatattgctaatgacatccgccatgttgactggaatatcaggaacaatattaattgtcgctccggaggcatctactgactggcctttaaacgctaaaatgttctgcatcagttgtagacgctggcgaattccacgtgttaagtatcgctgcttagtcgctaacaattggagtaaaccgaatagcttgtatttcatagcttcaccgctaatcgtccctgcaaagttttcgtcattcatgttagggacgtaagacgtttgatgaatgtcatccttaatcgacttaacaagtacttgtagctgtgattcgtcaaagctcttggtcaaccattcaacgctagcaccctggtcgcctttaccaggcgcttctagaataccgtccttcaagttagctccttcaccgtcctcgccctcatctagggtaaagccatagactaccagcaaggcatccacgaagttctttttatcggtgatacggtctgactgtaattcgttataggcgttgattaggctaatcgtttgctcaaaatcaccttgacgctcttcgttattacgatactcaataagtgggacaccattaaaataatgttgaatggccttaggtttgcttgccaaattagcatctgatagcactcgtcctgtcttggttcgatactgaataatccagtgggccgtatagacagtaatcaaataacccttagcattaccaagcaggtccttcttttccacgtagtaaataccaaacagcgaatttttatccaacgtgtcatccgttaccagcacacagccgcgcggatcaattttttcaattgccaactcggtagttgcgtctgacacctttttgatgtatagcagctcataggcacacccaaacacgcttaaatctttctccatctccgtattatgcgaatcaatatccatttggtcctgagcatccgtaatggctttaatatccttgccgttcgccggtgaaatggataccggattaccagttgtaaagccggtaatcatgtcagtaatgtatttggcgtggttcgtcattaccttttcatctgcacgatccaacttagccgccatctcaagatttcggcttaagatgtgctgattaccctcatagtagtgttccaacatgttataacggtcaatacgttgctgttgttgattgatagcatagttaattacatcaaagctagggttttcaatattgccagccaattcacggtcaatcgcaacgttggacccgcgcttcttgttcaaatcatactgcatccgctaacctcctatcctcttaatccctttggcttcttaattgtccgtgccttgagccgttcgtgtgtgttatagacggcataccgtaacgcgtccattacgtcatcgttaagcttgacgggtaagcccgtagcctcatcccagacatactgatagatttcatctaagaaggcatcaatcgcttctttgataacaaaaaagtggccttgcttcatgcacttagccaccgactcgattcctgataaaaccgattttttagcattgaacgccttgagcccttcacgttggaagcgtgcaacgtgttcgggtctcgcgctatcagcccaaaacttaacatttcggccatagcgatgctgaatatcttttgcaatctctacccagtaatcaatctcttcaaactgacgtgtatgttcttcaatcaaataagtattgccaactcgatcatcagccattacaacaatcgttcctttatgttcatagccccagtcgactcccgcatagtaagttaagtctgctggcaattgagcccgtggaataatcatttcgtccttattaaaatctttatacaccataccttcaccagatacccatagaccgagtattgcacggtcgtaaaacactccggacggcgtacccgctttttgatgttcaacgtattgtgggggcaaaaaggtattatcatcgattgtaaaatggaaactaacggttcctgctttaggatcatcgttatcaatatagctggctttcaagtagtgagtcggaacgtctgggttcgtatcgcaaataattcgcgcaccttgtgctgagcaccgattaaggatttcattgaatacctcttcattagcaaggctagcttcgttaatatacgccccaaacgaggtcatcccacgaatggcacccagccctgcaatagacccggtaaacgtctgcacaattttcacgccaaacagtgtgaaagagttatgcttgtcgaactgaaagttaatgtcatatttattcgtcagttcctgtaatacgttgttttgtagcgacttgcttgaataccccgctaaaatgtacattggttccttgacccctaatttgtcagcaacctgacgaacacgccgcagttccatcaagaaggcgtcattatcaacgacagttttaccagaccgaacagcaccatagtttatcagtagtcgccagtccgtccgccgcaaggttttcagcacttgaacttgtttcggcgtatatagctcactaattgccatcgctatcaccacctaggacgtcatccaatttatccagatattcagaaacttttgcttcagtactatcggttgaggcattcataatgcgagctttagactctgcaatatccgcgtcagctttaagcttgcgaatctgttgttcaacaagcttattgttatccggataacgcttcagtatttccttagtagcgcttatccgtgttttcaaatcagcttctttgtgcttctcgtacacaccgtcagcagtgccaatataaaccgtttctttggtttcgcctctagcgatactagtaagcaactcaacggcttctgtggcgtccataatacgcttggaagctatctcggccattcgctcatcgatgtaagatttaattccaacattttccaacaatttgctagattgtgcctttgcatagttgcgcgaataaccagcttcaatagcagcttgataagcatttccagacttgatatactcatcggcaaacttttgctgtttgggcgttaactttcgtgtcattacataccaccacacctccgtctaattggaattagtcatcgttattcgactacgacccagtcatcagctagcatatcagtttgactagctaaccatggaactcgatccataggtgcattcggattgttcgtgcgtagcccagtcgtgtcaatataaatgaaatcgtgagtcataacctcattaaaacgattattgggagtgttcaaagattctccctttttcaatttaatgaagatgcctttgccgttccaacctttacgtgcaacacaattacctcgttttaattcttcaagcgcttctccaaaattcataattgcttcctccttatttttatccaaactaaaagcgccatgcttatttgcacgacgcttcttatccttgcaccacttatctagccgagcatcggcctgcacccattcaggcggctcatacccgtatttacttcttatcattttcgccatgaggcacctggtcatcgatcagcttagctagccgtctcaactcatcaaagctaattgacattgctacactgtctccaccaacatcatcggtagccaataagaaaccacttgatggattaattgccaggcttagttcctcaccaaaaccatcttgataattaaagcttttttgcattgtgctacctcctaatcgtatgtactaaaaaagcctgacgacagccaggcttatgtattgttgtctcataagatggcgatcccggtattcaacaatacaatttaatatcatactatatttagtattatttgagttgcaatacacactatttactttactaaaaagagcccaactaaatgtcaggctcctaaacacagtcgttatcagaaaaacgattatagtttttgcaaccatgtttgattatgttaccacagcgcacatgtttccgcatgtaatttggtggccagattaattgcgccaattatgtgcttggcagggatttgcaccctacatatactggattttgtactctcctacttgttcttggcttctttcaaccttagcttcggatagcgtctacctattccgccacaagcacagccaatgtaaacaagacgatgggagttcatgttatgaagttaattccaaacacgactccagccacatctcaagctttcagcagtttagtgacttgcttgggtcaatatgattggtgtgggccaagtcgcgaacttatttcagattcgcaacttcccctgctaactatatcgctggtaggagtcgaacctacatcccattgtggcttaccaattagcccacagcgatactcacatttaacggccgacgttaaatacgaagactaatgccggcggcagagaggagcgcatcaccccttataaatccgccggctacacagatagctggatttgaaccaacatagacggttttgaagaccgccatcttgccaattagatcatatctgcttaatagacggggcgtcatatcaacttaatcaaggaggcaacacaaactgtacatctgtgcccgtctaacgtagcctgctggactcgaaccagcgacaacctgattaacagtcaggtgctctaccaactgagctaaggccacatgaatgctagacgtacaagctggggtggcttacctaacattcgataatactaatttactcccctttttacgctctgtggaacggattatgacggattgtgtacgtaaaataacggattctgtcggattatgccggattttatttactggcttcaactcgcaactctcgtggatagatttcagcaaacttcaaccgcgcttgtttcagtttgtcattaaacgttgtccgtgccaatggataaccatgctcatcaaactcttgcccatacttgaagcaacacttatcagtcgagaagccatctaaatacttccatttcaagatggctgaacattgtgctgacttttcatcagtatctgcaacaaagtcgaccgcagtttctaacaatgtcatctctttttttacccattcctgatcctgtaatcttttgtacattgcttcttcggtgccattaatattagtttcactacgtggcattccatcataggcttgcccgcttaatgcaactagctttaatcttttttgttccgtcttcaattgttgataccgttttaactccagatcaacattttcctcagtcgcctctaaatcatagtttttaaatacttcgttaaccaaagccgccaccccttattttgactgtgctataattaaattaatcggattcaatcttagcgcggtcagcgatggcggcgcttttttatgttatacttacaacggtcattcgagtggtctgtgactggtcgccttaacaggcggctttttgtttatcccacgctctaaacttaatcatcgtcgccatctccttgcgaataatcagtaccaacgtaaggcttatctaagtgctccatctcaaacaaggcaatcgtaattccatcttttgttttcgtgtcgccttctacttggcaactaatagcatcatttattaatcgcctacgtagctctttcatttcatcactcatttttaatcctcctaaattagtttcattccaagatactttgcttatggtaaggaacagtcataattgacgtgttctggcccttttctctgaaatgtttcgcatcttttctagcggcttgtctattggaatagacagctgccacatcactattaatcatcaatatataagccattttcagtcctccccgaacgcccgcttattaatgttgtacggctcatattccttggccaattgcttgctatctaatgctttagctttgtttgcttcagcgtgttgcttcatacgccggtgcttccgtttaatcgttgagcgcttcttagtgtgcttaggcatcttcgtcctccgtgatttcatctacttctactctaggatttcgtttatcaacggcaaattcgtcctggaatcctgtgatgtgctttcgattgtcgttgcctaaaagcccagctttcataaagccgtctagcacaaactttttagcaaacgcgatattatccgcatctttccggttgttcttcgtgtaccacgtaaatttaagcttgcaaggccagctgaattcgactccagaatttcgactagcccgcgcatatacactacataaggccgtgtaccgcttctttaggttagctgcggcgtatctgttggcccgttcagccttgatgtattcattcaagctaggcaattcacccttgatcacaactttgctcatactttcggcacccggctaatgtagtagccacagacaatgccatttgagtagcttgcttgccttatcgatctagctggggcgccgatcttatcacctagcaaatcaactgtttgtccagtaataatttcgttgggattgtcgtacttttcagcacgccagtagccgttccgcaacggcaaactgtacttgtgcactagatagctaacccgctgactaatatagccagtctcatcggtcaacgcccttatcgtatggttaccatcacgatgagcacggcgaatatctctaatttgctcacgttcctcagcttggggatctggtaacatactagctaagtaagcttcatcactgcgtacattagtcccaggcttaaccagtctaactggaaacggccattcgccagatttgtagttatgttgcgcgagcttaaacatttccggttctggaccgattgctagtgggtgatcgatatcgggtagatcagcgttaattactagcacctgtgtttcattcatgcgctcacctccgtttgcaatctttgtctagcttgctctagatcaataaaatactcggctggcttaccccaacattgggtcaaatcaaaatttaagccatcccgctgatattcaataattaaaacttcgagtgcaaatagtttgtactcatgagcgcacacttcatcttgcgcgctaccgccagcctttaaatgccgtttcatgcgctgcttagtccagtgtaatgcggccggttcataggcatggttagcggctaacttgactaattgattaccccaattcatttagcttcctcctgactgttcatgaacgctaggaacgcctcgtcgctcatatcgtcctgctcgttatcgcttgagcttggcttagaatccgcctgagaagcgccgttttgcatccactttggcgtaacttctttacggcgtggctttgaatagccactaggttttctttcgctcttcatgcggtcgtcatgattagcagcggcctttttagcctgctctaacgtcgtaatatttcgtttcttccagcccgcaacaattgcacgaacgtatttcaaacatgcattagatccaatctgatgttctccagcaacccaaattgcataggcaatcacctcaggcttgaactcttccagccattcatcaatctcaggtcgggcaataccatttggaaatccccacaggttggtccaatcgttaatgacctgctcgcgcgtgacacccgcgtcatcatcataagagtcagtatcagtcaagtcagggtcagtactagtaagttctttatgttctacgggttgacctccaccttgcccaaccggttgacctactttatctaaaccagttggcctacttttatgacttgtagttgggttactggttgggtaaccagctgacctactatataaattaataatgcgatattcaggtggtttaacatttttcttgcctctaacgtatttaattagtcctagttgcactaatgagttgcgtgctttatcgaggccgggttcggatagtcctgtcagactgagtaatgccgaatttttcatgcgaaactgaacgtccaacttgccttcatcgttcgcatagtctaataactcgcgatacagattattttggccgttagagacactcgcttcatacattttaaaattgcggtacgctcgtcgttgcttgaagtaatccaaattcgtccctcctttactaatgggcctttcacccgttcggtggattcagtcactgctgcattcaagccaattcgaatgtttatttcttatcaaatgccgctagcaacccttgtagctggctcttagcatcctctgcttgtgctactgttagattcttccaatcgtcgtcactgcctttccagtcaggaacgatctgctgcaatacttcgttggctgttgacatcggactgcctgactgtgtcttagtggtcaagtctccagctaggtttgcaatatcacgagtttgttgtgacgtcgcgatcatttcgcccgtgtcctccgacgccggttgagcatcttctttaggtgcttggtctactgctggcttacccttaagtaagagttcagcagctgtcttaaattcggccttcttggcgttttcagcgagccattcgatatagcttcgattttcgttcataactttgcccatggtcttgcccttatttttaccgaagttcagtttcaaattgaaggcttcatcgtacgtcatggtttcggtattctcacgctggttgaattgctgcatgtcttcgacatcttgcgtaaagacatttgataaactagcgatggtcagtgtggcatcaacttgagctcgcttttttgccatcttcaataccgtgtttttcattgaaaagccatcacgagaaacgtacttactctcttttgtatttgccgaccctaatccctcagttaactgcataccgctcttgtatagcacgcacttgacggtgtagtcgaaataacccgactcgtagtcctcaactttatcgataacgttgtattcgctggtcacgcccatcaacatttgaattttttcggcacccggtttaaggagcgtcggcttctgtgtaccagggacgaccccaaaatcttgaccatcttttagttgatgttgaaccatagtttggaaattagagatagcctgtagttcgctagccatcttgttttgatcagtacccatgattagggatagactgttcgtttgattttctgcttttgcgattgcttcactcatatcggttcctcctagtatttaaacgtgaccttctcagttgccggtttttcagtaataccagcgataatctcgccatcttccatgacaaacttgtcaccaaccatgcgaccagctttttttaaatcgactttatcaatagattccttgaccttgatatattggctcatgccctgattacgaagtgagtttaaaaccatcttttcgtcatacgccaacccagccgggttcttacgagttgatacacggccattaggggtatcgattttgaatttcttatcgactaaccgttgatcacgtaaatagtcggtcagtagcccttcgaagtactcgcggttggcttggttcttatcaagctcccggtcgcgccatgcaattgcctggtcaatattgttcttcgcaacttggccaatttcatcatcatgcgcttggatagccttgagcttctttaacgcccagtcagctttctccaatgagtcaattttgaagccttcgttttcacgttctgtcaccgttctaagttcttcttttaacattgcatccatgattgaaatcctcctatttaataatcagcaatgacgccactttcaatcagctcttcctcagtaggcacatcatcacgccaaccttctgcagcttcttcttggtcaaccagccagctatcgtagccgttcatttcgcccacctccgcgctaaacgttgtcttagtgactgtttcggagtacaatagaactcgaaaataaatttattaaacgtcttagctgcacgggtactaccaatactcgagcagcttttttcgtactcaaatttaggctttggcgatactttgcgtacttccaattcgttcaacctccttaaacgtgttaaaaagattattcaattcttcaattgtgatttgcttgtaaagcacatttccaatcctgaacgtgaacttcatcgtcttcatctccttaaattccaaaccaactagcaacttcatgacgtttgaaccacaatgcagttaacgcgcagcctactaatgctccttcaatcattgcgatgcctcctatccatttttccgattaactttatcgatgacttcttgcaatttatccatcgagatgccagcatactcagctttcttagctaaatcagttatctcggcgctaatctcttcagcgtattcacgtggataacgttcaatgactagctgctgcgctggtgtccgatcgtttggattaattgcaatagcattctcaaactcagcttccattgcctctcgttcttgctgctctttcttctgacgcattagggctgagaacatatcaccctttagacgcctgtcattctggaatgacagcactccgaaattctcgcgagcaccagaatagctaagccaaaaatcgttaattacatttgctaacgacttcctgatttgtggatcagtgcttcttgatccactcttcaaccgggacaattgtccgggagaaacatgcgtcctatctgcaatctgctgctgtgttagtgttttatctctacctaatgccaatgacaattgctctgcaaacttgttcttcatacctgcacctctgtattttggaaagggctttatatggcctttccatgtaattcacctataatttaaattaatcgggatgatctaataggtaatccatcatctcagctgctggaatctgccagccgttatgggtattcacataatcaatgaagccaccctgttcaatatccaaatcatggcgatgcttggttaaatatcgtgaggctcgttcggttgatttagttccgtatttatacttggccaaatctttaagcttccaagtacaaataccacgctgtgcttgcttccaggcttggaacctctcgtattcttcttcgctaatgaattggaagccctttggagcctcatgccgaatcaatatcgtatctgacatgttcgcacctcctaatatgaaactgacataagttggctagcttgctcgttatactcggccgttactgctcgaaattcagcatctagtgctttatcgcttagtgcctcaaacattactcttggtgtttctggtttaacctttgctagtgcattgattaaagtagttcgtgatagatgtgtcattttgtttcctccgttctttgaaaattaaatatttgcttttagtaactcaaatattcgacgcgcttcatcaatgttgctctcgttaatttgatatacgttagacacacctaaatggaatctaatgatcgttttaactgcgtctgacaatgaataagcttttgggttcttaccgtacttctcgttgacaaatttcgaaatatcgtttttaagctccatccaagcagtgtttcttgctttgactggtgctaggcttttggcggcaatagctgcgtttacctctgattggaccatttcgtgcaattgttcttgtgtgacttccattacttggccacctcctttggttctaataagtcatccacagttacacccattgcttttgcaagtaaatttagtgttacagcatcaggatgctttgttcggttctcaagagtatttacagtactctgtgatacgcccgcagcatcagctagctttgcttgtgtccagccaagcttggaacgaatttttttaatttctgagccaatcatgttttcatctccttagagttaacgcatttgcgtaactatgtttttattataacgccattgcgtaaattgtcaacgcagcggcgtaacttttttaaatgaatttgttttacgattaacgcaaacacgtttggaggatcttttatgactgaatcagaattaataattcaacgcttgtatgatcttatgcgcgagcgtaatttaaccgttaatcgtttggccacgttagcaggagttactcaatcaacagtgagttctttcatttaccggcagagtgttccaaaaatagatctattgcattcactttgttctgctctcggcatcagcgtccatgacttcttcgactttccgccttacaacgaggtggagaaataatttgccttatttgaaaggaggtgaacataatgccagaaaaatctgataaagaaatcgcagcagaactaactattgcaatgctaaatcataatgccagtctccataacgggatcgtgggacaaggtcaaggccaaagtaagggaaacattataaatggtaatacggttggcagtaattacgcttatctactcaaggtagttcagggagacattgatcctttgaagaagtctgatgaataactaattgaacatcatatttctcttgaagagttgctatttgcggtagcaactcttttacttgttcaatgttttgcatttctgcttcaacttttagaactggcttatcttgtttcattttggcatctccttatttactcgtattgtgtactttatcttcaaaaaaataagtccatttaacacgtttttttgaagatatatcgttcattcttacagccattttcttagctctaccaacacttggtgttctatgtccttgttcgtaagaagctaaagttgtctctggcatatcaagaaattcagcagcctttttttgcgttagtccgttgatgtctctccactcttttaaccaatgacgcatgttaacacctcctaactaagtaatacgtttcgcgtacctttgatgcttactaatataatacaattcgcgtacttagtcaacacaaaaatactctaaacgagtattttttatatttctgtacaaaatacgcattatgcgtagtaatcttataattaatgaaggaggcctatcaatgtttgctgaacgccttaaagaattacgaaaaagagaagctggtctaacacaagagagattagcaatgcaattaggcatggccaaaacaacactggcttcctatgaacaaggaaaacgacagcccgatcttgaaacactttctaaaattgcagatcgtttttccgtgacaactgactacttgcttggaaaaaatggcacgccaaaatgggcaaccaagaaagataccattgacctgaaggattttcttgaggcaaatgagggttcgatgacctatgggggtgaagatcttactgaagaagaaaaacaacaagtgcgcgtggcaatggcaacaatattctggaaacgccacaagcatgattaggagttgtacttatggatagagtaaaagatatcgttaaaactattgtcaatcgttatcacacagcggacccgtttgtaattgcggaaaagcttaacatacaagtggaatggtgtgattttggggcaatgcctctgggtaaaaatgcttatgacaaccaagagcctatcatactactcaataattctattaaacacacgcctacacagtatttcatactcggtcatgagctgggacacgttatattccatgaggggctgattgggtactacacttccgttaaacatggacattctaagtttgaacgtgaagctgatgaattttcagttggattgatgggaatgttgtttattgaggagaatggccatattccctattcatacagagaactgtcctatcaatacggggtaccattcgacggagattagtataaattaatttggaggaattatggaaacttttgccgagataatgttcttcatctcattgttgatatttatatattttatatgtcggggaattttcaaacttattaaaggagctagctcaaaacaatcttttaaatacggcttgattgctctcgctgcatcttttctatttgttgttgtaggattgatagctaatccagttaaaaacacagcaagcagtaaggacacgatagcacactcgaaaaaaaccagtacgtcaacgattgaaagtgccgataaaaattctaacaaaaggcattcgaacaaatcaagcagcaaaagaagtaattcgaagaaggctgcctcaaaaaaaacaagtagcatcaaaaagaagtcttccaacaataatagtgacactaagaagactgtagctaaaaaagcttcaagcgaaaataaagctagcgctaaaaaaacaaagaaaaaagtatacagttttaataaaattaagcttggcatgacaaagtcacaagtaatttccattatggggaagcccacagacgagagctcaagtacgcttatgtatggatctgatgacttagattttgaaaatgataaattgtttgatggatctcctgataaaattcataaagctgctataaaaaaagataaggctgaagctaaggaatctagcaagaaaagagtaaacgaaggtgacctaaaatcatttgctaaggtttttgggcaaaaagacgtcgaaactttacaaaaatacgttggctctgcatattcgtctatagaaacttcacagggaatggcttatgggtggaaaaccgattacggtatgctttacagattagatgatagtagcaccggcatcactcacgtatataaagatggtcttggagactctggtacacaactgtatgtcggtcagaccatcaaacaaaaacaacgtagaaattattattactataactaggaggaagatatgtctattattctcacatggttaataattattatcgctattatgtactggattttaaataagttcgttaaattcatgacaatgggacatctcaaactaaaggatttaattcgtgcaggcctttggtcaatgattggaattttcatctggaaaaagttacacccaaatgaagatataccagaccgttttaactcagaaattaataagtataaggaacttctcgcacagacacagaaaaatcacgataagaattaatattgctagggaatactaaaaagctatgtccaataagctgatcgacattaaaagctgttaaaagaggaggaacttcagcatgaagacaaagaatttagcgcttaccaacggaatcgtgggattagttggcggaatcatcttattatttgggggctggtttgtcgctggtggcgccctaagcgatgcggcaactggatcagcaacaagcacatcaggtacagtggctctgttaaacattttaaaaattgccattttagcattaggcatcattgcattaatttattataaaggcgattcaagagtaaatactgcaccaggtgttttactaattgtcggcggcgcaatcgcacttattccattcttaggttggattggcggaattatcgcaattattggtggttctttatatttagcttccctaaagaactttaatcaaccacaacaataacacaatgcactattttgaaggatatacctcaggtgtcaaaggcgtattaggtgcgaactttaacgttactttcaccaatggaacattgagtggtaaaactcaatctggtatgaaatagcaatttataactggcccttgattgggctttcacgcgagcgtagttcaacggtagaacagtactcctttgaattgctaactagatactttcagatgcaggttcgacccctgccgctcgcatagagattcttaactcaatcaaacacaggagaatcaccaatgttcaattctttaacttattttttaaaaagcctgtcctctattaagtggagcactgagctattatttgtggcaattatatcagcattagttgcatattttctctataaaaagcttcatcactaattgattacaaacgtgggtgtagttcaacggcagaacggcaacttcttatgggatacccttcctttatttcttattgccatgcgggttcaactcctgccactcacattgaccagtcaggatgtcattaaaagctagaatatattttcaggaggatatttaattgattcaagaattcaaagaatttatctcacgtggtaatgtaatggatttagcagtcggcgttattattggggctgcatttactgctatcgttaaatcattagttaataatttaataaatccactaataggtgtttttttaggacaaattgatttctctagccttgttttaaaagttggcaatgctacttttaaatacggttcctttattaattctgtcattaattttttgattattgcatttgtggtatttttactagtcaaaatgattaataaaattatgcctaagaaagaggatgtcaaagccgatcctattccaacagctgaggaaaaatatctttcagaaattgtatcattattaaagcaacagaaaagataattgcagtaagaaatcaggtgccatttatgaaaaaatcagaagatttatctactaaagattggaaacaagcacagtctgccgtcttcaaagagtacgaagattttattaaaagagttcaagaaaatggtgtaggctatgctattcagcatgcaagacgtttagtaaattaccaaaaattagttaccgaatggcaacataaaacaaatattttaagggacgatctatctaataaccacgtcgctttaagtgtttttaaagacttagaagaaggaaacgaaagtcatgttttgagtagagcttacgagattatgaagaagtggccagagttcaacccagaaccattaaccatttggctagagctcatcgaagactcagatgatgaataataaaactaaatgtcaaaggaagaattccaaatgaagattatcaacgtcgcattgcatgttaaaccagagctcaaaaaagaatatgaagatttcattcatgaacttgttattaattcagcacaagaagctggtaatgaattctatggacatttcaaaaagttagacagtgataatgattacgaaattatcgaacactggaaagatcaagaagccgtggattttcataatgacacccctcatttccagaaatttctagcacacgtcagtgactatctaacttcagaaccagaaattaccagaatggattattagctttctcgctttgcaaataagtgaaaaaacagcacttatttgcaaagcttccggacctttagctcagttggttagagcagacggctcataaccgtccggtcgttggttcgagcccaacaaggtccatttcacgcgagcgtagttcaacgatagaacagtactcctatgaattgctaactagatactttcagatgtaggttcgactcctgccgctcgcattgtaacaaataacccatactaccgcttactttagtacgtacatcgcgtgggcgtaattcaatggtagaataacaatttcagcccttctctctcgtttgaaattgttatgtaggttcaatccctgccacccacttttaaaagaaagaaggtaagattatggataaagatatgtcgaaatatgaactcatagataacattactaatgacttaacctcttttattaatctgtatgctttcgtttatcttacaaaagatagctactcaaggaaagaatgtggccgcataatccaaggaatggaaagagatatggttgatcgtcttaagcaaaaataattgtaggtacattctaattaactgttgagccgaccaaaacccattgttggctcttatgcgagtgtagtttagtggtaaaacgacagccttccaagctgtagtcgcgggtccgattcccgtcactcgctttgaccattattatcgatcaaaaattcaggaataattatgaaaggatgcgattttttgaatgatgatgcattatacatcgacatgattcatgaagaagaattgccaaaacgaggttgtagcaagccaattaccataactgcttcagatggtaaaaaatatatactaaagaacgatatggtgatgtatcctacagaaactaaaccatctaagcaagatgcagaattctttcaagaagcattagtttctgaaattgcaaaaaaattagccgttcctactccaaattacgctacaataaccattgatgttgatacactttctaattttcctgacttacagtggaaatataaattttctaagggaaagtatttcgctactgaaaaattaccgaatattggtaatgacttacttgaagtattcaaattagccactgatcacagtcagccgtacgctatacgtggatggcgtgctctatttaacaatgttgtaaataaggaaataattccaaatcttatctgtttagattttttaacccttaatcttgatcgatttacaaatggtggaaatctcctctttcaatatcaaaacaatggtaagtggttagtatctattgactacggattttgtttcttctctccgtactggaacacagatcctgtaagtcaaagaaaaatcgacttgttaaattttaataacccaaaagtaaatccagacataactacatcatactcagcaactatgatgttttggtttttgaatagaagcaaacaaatgcatcaagcttctaagttcaaatacggtgttgtctttgacgcattacaacgcgaactagattttagttcaaataatccttttagtgatgtggttgctgaaattgaatcgttaaccaatactttttttgtaaatacaatttctaacattactcccgattggatttccggtggtaatatgcagaaacaggcttatgtagattttttaaattagcaccagaatatgttcagacggctttttttcagctatttgacgagggaatttatgtagaccagaattatgaggtgaatatgcataattctattattatctgcacgacaaatttaatggcgagagaggaaatatattcaaccctgggtgaggcattagtctctagatttgatgcactagtaccatttgtggacttttctgaagtggaaaaggatgagatttcacataaactattagaagagtatatgaagtatgatttagaaaaaaagtatgcgaatcggttagacaaacatcaagtgttaaaaactttaaaactagggattggtggtcaaaataacttcagagatataaagaacttaattgaggatgtaatagcagagaacttaattgaaaatggattgttttgatactatagttttttgtatattatgttgatgtttttgtgatgttacgggatatattgtttgggatctattatttgtattgctgacttttggcttctcgttcttactgtgagaaatattggtgagctgagctagtttctttatgtgcttcggaagagtagcctctgtgcattaaagcgcaggggttattttttaattattaatcaagtatgctaatgtgatggaggtgcagcatgaaaaaaatttatcattaaaaataacttagctaaaatcatgaagaatgaaaatatgacaatgagcgagcttagcaatcgctcaggtgtttcgcgacgaacaattgctagaattatagatgatccctactgtaatgtgagtggaaatgtaaggctttcactttcaacgaccatgggaaaaaggtttgaggatgtgttcattgcggtacttaatccagagttagaaagactgaaatttacgaaagaaaatctgatgctattagatcatttaattgaatcacagggtattaagtttacttacagcacgtacatggatgatcacaagatgaatattagtactaagtacggatcgaagcgacgggttgagttttttggtaattttctgatagacaggtggggagagccgtcattaaagctgatagattttgacttaattaaacgaggaaaccttattccagaaaaagaacgaaaaatatggtttatgaaaatattaacggtatgtgtggaatatgccaaaaacgtacatttaaacagtgtgatgctaaggttacaagcagacaacatttggttaactgacccacaagtatcctttgagaagttactaaaacgagtaaatgaaactgaaaaaatcaatcaatatttcctcatggggtatgcgactgcatatcaacttggattcagattcgatgactttaccacacgccacagagaggcccaccatgatttctggttaaaaaagcaaattcactgaattcctttagttgagttatgaaatctgatttagtgtaattagtactgatgtttatttttaagtgtcgcaagtatgtcgctattagttgtgttgaatagtacagtgtataatataaaagtaaagattctaaactgactatattcattttgatttctaaaactaaaaacgaatcgcaggtgcatccatatcacaacaatcaaagaaattacggaagctatcaaggctgatcccgataacgctgaatatacggcgaaggggtgggacccgctatttcatgttttaccgacagccactattttagtgatcagtcaggcgccgggacgtattgcccagaataccaagacgtatttcaatgatgcgagcggcgaccgacttcgggattggatgggcgtgacgcgggagcaattctatcaaagtgaccgcattgcagttatgccactagatttctactatcctggtaaaggcaaaagcggtgacttgccaccgcgcaagggcttcatggataaatggcatgaaccgctgctagcaatgatgcctaacgttcaactgacgttgcttgtgggccaatatgcaattaaggcttatttaggacgttcacggcaaaagacgttgactgcaacggttcaaaattatcaggattacttgcctgattatttcccattagtgcatccatcgcccctaaattatggctggcaaaagaagaatccatggttccaagcgaccgtggtgccagatcttcaacgacgggtaaagattgcattaaaataaagtctacgatagccttgttaaagccagtgttcatagcttgttgactgtaacttcaagggcctgatttggttaaaaacgtggtaatactgagcgtgaatgctacggtattaccacgtttttagtttaccaatttatgacgatgcgcttagctagccaagctttctcacttggaaaagatagtactatcttttataatgatatttattctctttgttcatcactatttaaaatataggagctaaaaattcatggaaacaattaaagcgatttacacccggcattcagtacgggcttttaaagacgatcctattgaaccacagcttttaacaacgattgttacagatgctcagcaaaccccctcgtggggcaattcacaaccatggcaagtctatattgcaacggggcacgcactaactaatattaaacaacactatgctactgccgctgagcaagggattgcggaaggcgctgatctcgccaaagtacaccggggtgatttttcggcgtttgctagccaaaatatggggcactgggtcggaacttttcggcccgtgatcgactcagacccgaccacttattgggatagtcgtgctaatctttatcgcgcaccggcgattgcctatctcgtactcgacgctaaccctaatagttggtcaatctatgatttaggcgctttttcgcagacgttaatgttggccgcaactgctcgcggagtacagtcagtaccatcttatgaattggttaaatatccggccattgtacgaaatgcactcgggatgcctgcgaataaagtagtggcgatggggattgctttaggctatgagaagcctgaaaaaccgttaaatcaatttcgaactgaccgagttgctacgccgcaagttttgcatattatcaactaatttagactcacttttgcagcagaaaaccagctgtttaccagcagacactattgccaaccgacaccgtttcatctaagatggagggtaacttgaacctgataggggaggctgggcaatgacgactaaacaacgaacgtacaaaataaagtcctatgtcaacgctagccatgcggtgcggtgggcaactggctccggaaaaaagcacacgcacacgtgggaaattgtttgtgaattgcacacggttgatgcgatggtcgctttttacgatattgaaaaaaacttgcatcaagcgttggatgaattgtcaggtaaatttttgaacgacttacctgaatttaaaactgttaatccaactgttgaaaatgtcacggagtatttatttaccaagattgataagacattgcgagacaacggggcgcaactgctgcgaattgaagttagtgattcgccaacacgcgcttattgtattagtgtcaccgaataagattaatgaaaggggccaccaagaacggcagttgcagctgttcttggtggccctgatttttatttaattatcgttttggacggacaactgctaaaaagtcagctaaagcctgcgggtcggtcaattgtcgattacactgattactgtcacgacaaatgtaattgccgttacgcgtgtaaggtccgagaccagatgacttggttgtcgacataaagagtgcgacgttgccaattgtttggcaaatggcacagacgcccttgactgtttgtggtgctaaatctccctggataccaatgagacaatcatgatccgggattactaaatactttttttggttaccaccatcattccaacctaggtaagtcaattcgtgtaatgctaattgtgaccatacaggctgcttcaactttttgaccttgcgaaacaacttgcttagttgctttgtcgtcaaggatggaaacggaataattagcggaattagcgtttctagtagttgcggggccttggcacgggttagccggtccgtttgcaaatgggacaagaaattagcggtgattggatcgtcactaggaagcagtggcgtaatccgttcgatagcttgtgcccgtacgacggctctaatttggagatcgtttacggcgagctcggcgctaattaactgattgacttgctgagtaatataactgtattgataggtggtaattgtcggttgcataatataattcctttcagattcaaaccagacacttctctgaaaggttctgtcgaaaagtgtcgctaacgagcagcacttttgcgtacagataatgatgccatcatcattaatcatctccttattgtggccgattatagccacagcgataaacagtataacggatactgctgattttggcaatagatggtgtctgttttgataggcaccttgcataacttatatttggaaatcaaataccgtaagtcctaaaatgtttcacgtgaaactttcgccacgggacactaaaacatcacgcaactcgtgagttacgtgatgttctcaaatacatattcgctttgaattgtgcttaattcgtgactgaatctttgacttgtttcagcgcattttggaccgcttctttaatagctcggctagatgcagaggcacctgaaacggcgtcaacgctagtggagttggctgccacaatttcttgtggaatttgatcgatagcggttaaaccaacatcttcactttcatggtgttgaataacatcgactgcttgaattttatggtcgttgtaagtcacacgcacaataactttgccacctagcccggcattggaactgccgagatattgatcagcggccagtttaacattagatgctgtttcgccatcaacaaggtcattaattccgttggcttcgttggcggtgacagattcactatctacctttggacgagcagcgttttcaccggctaacttaccaaagatcaaacattcggctaaattaccaccaccttgatagcagtttgcaacgataccgcctaattcaccagcgccgaacaagtgtggaataggttcgtcattgacgttgagaatttgggcattttcattgcgttgtggcccaccttgcgtgttgaggacgtcattggccgcagcaatggcatagtaagggccatcgtccagttgacgcatcgtttgcggatcacgaccaaattcaaaatcacgtcccacttctgtgtagtgattaaagtcagttaccgtctgttgtagattattagcaggaactcccaatttggcggccaattgtgcaatcgttggcgcggaaacgagcttggtcatgaatttcggatacggtaactgaccagcctgactttcttcttgtttgaaggcatcgtactgggtttgatcaaaaattaagtaggggtgctgattattcattgggattagccaagagccatgtgtgtagacgtgtccgtgacggtgcttagcgtcttcttggaagtagcgtgtcccatcatcagcgataacgaaaatactaccgttctttaataaaggccagtgttcaatttgacggccccgttcattggcgtcttctttgaaggtgattccaggtaagataccgtgagattcataattggtcatgtgccacattttggcatcaacttcttgagccattttgataccatcaccgcggttatagagcgtcccaagtggtgtcagattatcactgtgcaagtaggtttgctttaactcaggattgttttcaaaaccacccatagctaaaacgacgccattattggcatggatattaagcagtcgttcgccccgtttgatttggaccccttggatcactttagtattaggatcttggatcaaatgttgtgcccgtgagtccaaccaaacgtcaatattgtcagctcgttcaaggactttttgccggagtagtttccataatgcagcgtctttatcacgtttgtgaacgagggcaaagtcaatcgtatcacttccggctagttctgggtattccgccatggttttcttgatggcaacggcatcaccgggtttaatatcatgtttccaactaacggctttaatccccagatatttttcaaaatatgctggaattttactcataccgcttaaataggcgttgagtgtcttagtaggggtactgaatggcgcgcccagtgcttgataataagcggttagtttatctaagctttcacccgtaacgacgtgttgggcggagtagcgggtgttgccaccttcacggccaaatggtgccgcatcaaccactagtacgtgggcaccattatcagcagcaaaacgagccgctgaagcaccagcaccaccaaagcctaaaacgataacgtcgtagttaccgtgccagttcacattgagcgcgggcgtgccgttgagtgcattaacgtatttttcaaagttatcgaagcaccgttccaagaacttgatagaaggggcatcggtcatttgaccattctgatcaaaggctttagcagcgtagcttaacatgtattcattgccagggagtacctgagcatcaactccgggcgcattgagaatattgcgtaagtcaccttgagcacggcacgtcccctgtacgccaagggaagtaccaactaacatgaccggtttattagcaaaggggtggagctggtaagaaagccattcaataacgttcttgagtgcggccggaatggcatgatcgtattcgggtaccccgatgatcaccccatcggcctggctaattttatcatttaaggcttgaacggtcgccgggatatgattttgagttggttcattaaaaaggggaatccctgtaatttcattaacgtcaatggtagcccgttgactaaaatgatgcttcataaattgtaataattcacggttgtaagactgttgtgccgccgtaccaatcaaggcaatatatttcataattaacattcctttattagttttttagttggataagtacacggattgtttacgctttcaatataaatagttacctagaaaaaacaaccgttaattttaacgaagccaacagaatgctattgtgacaaggataacaaactgtgattaatttgacgggttgtcgaaactttagtgagaattaagcaagtggcaaactttattttagctttttataaattctatttataaaagtgtccgataaaaggcactagttgctatgataatttcaggtatttttaatcgcaaacaggtccctgtaggctgtatataacgggttttattgcgacacctcaagcaactacaactaaatttaaattgacagacttataaattaagttatggtgatattgaaaaacggcaaacaaccgttaatggcaagatatgtgaaaatcttaacaattatatgaagattaggaggaagtgcagatgttgagtgaaataaaatggaagggctttctgttaccgctaatttttggaattgggttatggctagttacgccactacgaccagtagcaattagtattatggcgtggcacttatttgcaatttttgtggcaacgattattgcttgtattaccaagccattaccgatgatggccgtcacgctgattgggattgttgtcgcgacgttaacgggtgtttttacgatggacgaagtcgctactggttttggtaattcgacggcgtggatggttgccatgtgcatgttcatggctgctggttttattaaatcaggacttggcaagcggatcgcctatctgtttgtcagtttatttggcaagcgcacgctgagcttagcatacgccttatcctttgttgatgccgtattggcgattggtattcctagcaataatgcgcgggtcaacgggattatgtatcccattattgataatctttctcgtgaaatgggatctgatccgaaacagggcacacagcgaaaattaggctcatttctcatttttaatgaatatgaagttaataatattacatcaggcttgtttttgaccggtttagctggcaacatggtggcgattggtttagctaagatgcagggaatcacggtaacttggatgcaatggttcatggctgcttgtgttccgggtgttttatcgctactaattattccatgggtactatataaagtctatccccctgaggtgaagcaaacgccagacgcgcaccgctgggcaacgacgcgtttggccgcgcttggaaaaatgacagctagtgaaaagattatgtcaattacctttattttagcgattgttttatggttgatcgggactaaaattggcatcgatgcgaccgaagtaagttttatcgcagtcgttattttgctgattacgggcgtgctaacgactaacgatttgcttaatgaacattttgcttggaatattttagtctggttatcgatcatcatgatgatgtctaagaagttaatgacactaggctttttcccatggttttccaaaacgttaggtcatttactgaatggcatgaactggattagcgtgctcattatcctgtttttagcttatttttacttacattacatgtttccgagtgtttcaacacagatttcggcattatatgctggctttttatccatcgccattggtgccggtgttccccatgttttagcggcgttactgttggcattcgctggttcaatcaacttgtcgacgacaccgtactcggccgggcccgcggcattattgtcaagtacaggctatgtgactagtgcagagtggtggcgattgagtgcaattattggggttatttttaacgtcatctggttaggtgggggcttgctgtggaccaagttattaggcttttggtaagactaactgagcaatatagatgcggtaagtcgtgattgatcctgaccacgatttgccgcatctttcgtgttaaaattaggtattaaatagattgaatgggggcgttgacgtgaatgaacgcgatttaaagtacttctgttcattagttgagacgggaaattacacggccacggcgaccaagtttcacgtcacacaaccggctatttctgcagctttacgacgattggaagaagaataccaagcagtattactaacgcaggccaaccatcgggcccaactagtaacgacggcagcggggcggaccttgtatattaagtctaagcaactcttaaaagacgttgcgcagatggcactggaagttcatcactctaatgagcagcaagttcggctcggattttccaatgttgcgggtggtatttggcttccccgggtgataaaaaaatttatctcagttgatttattagaccaggtcacaacgaccgttgctgattcagaacaattgttagttgacttgcggcaaggcaagttagacgcagcggttttttcaactttggtcccagaacgtgccacggatttacgggtgagcatcttagaggaacatcagatgcaggtcttggccaatgtcaatagtccattaagtcacttaaaaacgattcgagcaactgacttacaaggagtgcctatcatcgctcgtcctaaacacgcattaccacggttagcattagaacaatattgtcagcgcggccacatacagcctaaaatcgtctacgaggcagctaccaacgcgttagtcgaaggtctagttgctcaaaacgttggtgttggggtggtcattgcggattccgtagtgctaagtgatcaggttgtagggattccactagctgcccaagagcaattacactgttacatgcaactggcggtgcggaagtcctttttgcctaacgctaatcagcagcggtgcattgacgtcctacgtcaaattagacgggctaattaggtcttcagcactaatccaaaaatagcgctcgcattgactttttcagtcaacgcgagcgccgtcaaatcattattgagctaacattttttgagcgaattccttaacgagttcaatctgctcatctttgagcttgccgccagtactgccgatgattttcattcctttgccacccatgacttggtggaagtggccgatgacgggaatgcccttttcggtggcaatctttgtcagggctttgtctgaaaccatttctggtccgccagaagttgtgaatagggcgatttgtttgatcttagtcggatcaaggttcttcataaaagcagatgcggttttgtcgggtttcataaaataagtaccgccgccaaaaaagagtgtgtcagcttgttcgacaggtgtatcgatggattgtgctggaacacctgccacgctagcgatttgttcggcaaatgcttgtgtattgccattgcgagtttgataacgaattgctactgtcatggaaaagacctccgataaattagttgaaataagaccgttctcgcgatgagtaactgctcagggggactggttataagtttagaataatattgtaatatcaattctagtataaatcgttttgaaatcgattacaaaaatatagtgagcgcattcttgagggttaaggctagtttattcgattgctggaatagtcacagcaatctatcgcggttacgcgcatgacgatgttgtatcttaatggttattagcggagcaagcgggattcttgcgggcataatattggtgatgatacgcgattagtgtcgttatcgtcagtaatttaggaggacggcgaaatgccaaaaatatattttttatgtacgggcaatgcctgtcgcagtcagatggcagaaggctttgcacagcaattattgggaccaaactggcaagttgctagtgctggggtggagacacatggcctgaacccactagctgttcaagtaatgagcgaggtgggtattgatatcagtgaccaggtttctaaattaatcgacctgacctatcttaatctgtgtgcagtcgtggtgacgttgtgtggtgatgcacgggatcgctgccccgtcactccggcaacggtgaccaggctacactggccattgcctgatccggctcgcacgactggcagtgttagtgaccaattgctagtatttcgacaggtccgagatcagatcaaagcacgagtgattgatctggcacggaccttgaatgtttcggcaacgtagccgtgcacaatgaacggttgcagtattaagaaaataaatccaattataatgatgcgcatgtaagctaagaagggctggcatgcgtttttattagctaattaaagttggaaccacactttagttagttataattgtaaaccaacacacatgtataaaagctacagtttaatcgtcgtaagactagtacttttatccattactcaaacaaatttagtgggttaatatgaaagcgtagtcaagataaatgaccggtcatcaggttaatgtttactgataagttaatagaatcacaatttcatcgaggaggacgcaaaacatcatgaaagattttaaagataaagttatgtttatcacgggtgcggcccacggatttggtcaagttattgctgaaggcgccgcggatcggggtatgaagctcacgattgttgatatcgacgaaccagctttgaagaaaacgtaccaacatattctcgacaagggtgccgaggtgttgatggttaccgctgacgttacaaaggaagctagtgtcgacgatgcggttgagcaggccatggaaaagtttgggcggatcgacctactgattaataatgccgggatcgcgctacctggccgaatttgggaattgccgactcgtgattgggaatggatcatgcatatcaacttaatgagtcaagtttatgcgatgaagcgcgttatcccaattatgattcaacagaagacccatgcggatattcttaacgtggcttcgattgccggcttagttgatacgcccggaatgccttcttatcatgctagcaagttcgcttctgttgggatgactgaagcgaccgcctatgacttacaacgggctaatattgatatcgacatgcacgtgatgtgccctggctttgttcagacggatctctatcacactgaaaatcaccggccagcgcaatacagcgacccaacggacccgtattatcaaagtgaagcgtacttaaagggacaacaatttgcgaagtatgtcattaccaacgggaaaccaattgatacgattgccgataccgtctttaaagccttagaggataaccgtttctacattttgacccatccagaatataatccactgattgaagaccgagttaaacggatcgtgacggatggcgcaccagacgtgcacatcatggacggtatcatgtaagctaatcacgcaaacaaaggagtgttttaccatggcaagttttattgcaagtgatcaggatgttaagaactttttgacagcaccaagcatgaatgaccaggaaggtattgggtttgcttatgccactgacgaagcggtgcttaaggctttaattccagcaccattaaaattaatggcaccggtggtttgcggttatgtcgttcatatgggaaaaccgacttttagtgccccataccttgaagaaagcctatttgcgttagttagctacaaggataaaatgatgggcgcttacccgattaacctcttactccacggtcccggggcagagagtggtgtgattgcaggtcgggaaggtgctgggattcctaagaaattagcggatgccatcgaattgcgccggaatgacaacagtgcgacagccacggtcgaacgccatggcaagacattactgaacgtttcgtggacggccggtgaactgaatgatccgtcaattatgaaacaatttgcggggcagctcgcgttaggtaaggaagccgaaatgaatagtttcttctacaaatatgacattgatcaacatgaagatgggacgaaccatttcagtaacgtccaattagttgcgactcaattacggtccttagctgatcaagttgaacctgggaacctaagtattcagttggagtcaaccgatgatgatccatttggcgaattgaaggtcttgaagccactcggtgccgcttggttccacttcgacacgtcagttatgttcaacacactgaagttggacgaagttgatgctgcgacaacaatgccgaagctcttaacgggtcggtatgaccggagtttcttcaatcccaaggcagcgacttacattatttaggcggattacgaaagcgaggaatagctgatgtcagaagcagtaaaaaatttggtgaacaatgatttagcagacgtaatgtttaaccgccattcagttcggcagtttgacccgaacgttaaaattggacgtgatgagttacaaaagatgattgcggaagcagccaccgcgccatcggcatgtaatttacagtcatggcactttgtcgtcgtggatacccccgaggcaaaggctaagttcaaacaagccgtgatgaaattcaactacccacaggtcgacagtgcatcggccatcgtctttattgccggtgatacccagtcgcattatgtttatcgcgatgtctggaacaaagtttatgaggatgggaatattacgaaggaacgcttggatcagattctgggcaccttcttaccattatatgaaaatgccacaccagatttcttgaaattcgatgcgacgattgattgttccattgtcgggatgcagttgctgctagtggcacgggctcatgggtatgatgccaatgcgttctccggaattgactttgaaaagatgattccgacgctgggtcttgatcctaaacgatacgtgccagtaatgggaatcgcaatcgggaaagcagcgcaagaaccgcttcatacgactcggtacgatgccaaaacacagactgatttcttagcctaataggtttatgaaaagagcgggattcccgctcttttttgtccgaatacgggcctaagaaagctgagggcctttcgagtgggataggggggttgtcagtaggttcctttacaaaagcgcttacattatttatgatgaaggcgacaagcgtgaataaggaggttacttgagtatgcaattaaaaccgttattgcggcagttagccacaacgtttgtggtgactgtcgatccaacatttacacataatcccgaagttactcacgtccaatttgttgatccggcagaagtgttagcaagccaccggttatatttgtcccccgagtccagtcagctagttcggcttgcctatagttggcacggccatcgtcagtcggtcggactagtcaatctgggaaccggtctgaccacgatcattgcggcgcaaaaccagttattgaaattattaatgatacttggtcagtgtttacaccatgacattcaaattcaaccggccatcaatcagctcgctattcaagcaattacggcggattttgataccacgttggcccaagcagtacgcttattagagaatccactggcgattattgatctgaacggggagattctgacacggtcgcatacgacgcaactcaatgggactagtattcacgctgcagttgagacgaatcgcgtcggacgctggctgttagaccacggatttgcaccggatacgccggtttttttaacgcaagtctacgtggcggaagatcagttgtcggcggggcccatgctaattacgccgttagcaaatggcaccgagccgatcggttatttggtaatgccagcactcaataaaccattgaatgatcgacaagcactactgatcaattcgattggtcaggttatcgccggctcgttagttaaaaatcagattatgccaacagctgaatcgcaacgggaccggttattaaacttattattgacggaacatcaagggggaacgtttgctgatcagtttgctgaacaacacgtgcaattaccgacagccatggtgttaatccgctgcgaaccactagctgatcaagcaccgatgattttacagcagcgactacagtacttgatgatgccacgattcaaacaagtgttggtttcgacgtatcagcaacaatgtgtggcactgatcccaattagtctggtcgcatataatcagaatcaatttaaactaacgttgcagcaaattacgaagcaagcggattgccgcttgatcgtgtctcagcactacgttaatccggaagatacctttgccgcgtatacagtttgtgaacgaacagcgcaactgaagactggccgtggtcgggtgattttttgtgaagaccaattctataaccttgcgttggcacgagttaatcaccttgagatcttaccgttctttattaatccagccctacgtttgttgttagcctatgatcagcaaaaccatacagaactggtaccaacattagatgtctacttacgggcgacttgtaatttgacccgcacggctaagcaattatacgttcatccaaatacactgcgtaatcgactgcaccatatcacaacactgaccggatgcgatttacgggatgcggaaacgtgctttaaattggctgctagttttaaattacggcaatttttaacccagcatcagtaccagtatcgactggatattccaattccgacccaagattaagcggggcataaaagcgtgcaaccgtttgtggaaaaatggttggatcagtcattattagtaaatccgtgaattcaggatggacggcagtaatggggccgccattgcgatttgatcggcggcagtcgtgtgattggcaacagtcgtcattaaaattgttatgcaaccggttgcattaaagctgaaagcgttttataatgttaagtgaacaataacggtgtgcttcaaaacaagacgggtagccgtcactcttggcgcatctattgatgattgcgcagttgtccggtacccagcaatcaattgtgctggtaattaacgaggaggaaccattaatgagtaaatttgcagatattaaagggtttgtatttgatttagatggtgtgattgcggatacgtccgtttatcattcacaagcttggcatcaattggctgacgagttgggcgttgcctggagtgaagaacttgccgataatttaaagggtgttagtcgaatggactcgttgaacttgatcttaaaaacgggtggtaaggaaaacgactatacggaagctgaaaaagtggcttacgcagccaagaaaaatactaattatctgaacctgttgaagggaatggataaaactgcaattttacctggtatcgaagacttcttggctgatctcgctaagcatgggtatcgtttatccttggcctcagcttctaagaattcaccattggttctggaacagttaggcttggcgcattactttgaagcccgggtggatcccgcaaccttgaaacatggtaagccagatccagagatcttcgcacgtggcgcggaagtgcttggcttgaagcctgaagaatgtgcgggcgttgaagatgctaaggtcggtattcagtcaattaatggtgctggtgaaacgtcgatcgggattggtgatcctgccattttgacgggtgcggatgttaacttcacttcaacgagcgaattaaccttagctaatctaaaagccgcgttagactaagtttaaataatacgaaaagcttgcatcacaaaatcaactagatttgtgatgcaagcttttttgagttactgcttttctgaaagtcttaatgggccgctggcaaggtggcaacatcgggatttagtaattggacgtgtggggtgcgactgaggacgtattctaacggaacggtctgttgttctaataaatgatcagttaagttaacttgctgaatcactcccggattttcgtacagttctagtgcgtacgtttgatgattcaagtccatgtagctacggtactcagtataggttgcttggccgttggcggctactttggcgcccttgggaatagtcacagcattcaagatgtgttgaagtaagttgactgtatctgttgttgtcgctggcacttgcgcatagtgtttcaagaagacggtccgtgcgaagcgagacatcgaagtatagtcaccaggtagacctaatgcgcccgtaccaggtccctgtgaaccaggttggtagttaatgaatttatttagtggtcgctcggtgttagtcagggtgccatacttacttaagttttgtagctgccatttgaggtttggtgaattggtcaggacgccgactgggttattaagcaggcgaagctcgccgctagttggttccaagacggcggtttcaccggtttggtcactgatgataaagtgaagtggtggaatttcgttaattaattctgccgtgctactaattaattgaacgtctttgacgcgctcacgtaggtcagcaacactggtgatttttccgagtacccaggcgacgaaatcgtggggtgcgagatcgattttgtcttggttactgtgtggctggtaaattgcatgattcggaaagtagagtgctgcgatgctgacaccacattcgttaacgccgtccgtgaaaatttcatggttcagttggcgacccgcgccaataaagccataagtcgtggtgaaatcaccaaggtcacccgtcacgcggtaatgtcgaggcatgaacataatacgggtctcaaagtcaacgttaaaatccattgtacgagctaagaagtggcctccatgactatttgtataagttagactagtgcacatacaaatcgctcctttattagatgataacggtaacttatcatatgattgcggatagcggcgaaaattgtgacgcttaaattaacgaatggtaatcaagtttacttttgagggggtagttcaattaacaagctggggaaactcatcatgaggctaatgtttcacgtgaaacattatgcttttaaaatgacaaaatcgctatcataaatgatgttagtagcctaaaataagggggaaagctactaacataatggacgatctaagatggaggaagaaatgaataaagagcgtaagtcggtgatgccgctgtcacaacgacatcatatgacgattccatggaaggactttatccgtaatgaagatgttcccgctaagcatgctagcttacaagagcgaacatcaattgttggtcgagttggcattttaatgttgtcgtgtgggacgggagcgtggcgggttcgtgatgcgatgaataagattgctcgcagcctgaatttaacgtgctcggcagatatcgggttgatttcgattcagtacacgtgctttcatcatgaacgtagttatacgcaagtattatcgataccaaatactggtgtaaatacggataaactaaatattcttgaacagtttgtcaaagactttgatgcgaaatatgcacggttaacggtggcacaagtgcatgcagcaattgatgaagttcagacgcgtcctaaacagtattcgccactggttcttgggttggcagctggcttagcctgtagtggatttatcttcttacttggtgggggtattcccgagatgatttgttcctttttgggcgcgggtcttggtaactatgttcgggcgctgatgggtaaacggtcgatgacgacggttgccgggattgcggtcagcgttgcggtagcgtgtttggcttatatggttagttttaagatttttgaatataatttccaaattcttgcccagcatgaggcggggtatattggtgccatgttattcgtgattccgggttttccgttcattacgagtatgttggatatctctaagttggatatgcgctcaggactggagcgcttagcttatgcgattatggttaccctgattgcgaccctcgtcggctggctggtcgcgacactggtgagcttcaagccagctgatttcttaccgctaggactttcaccgttagcggtacttttattacgattaccagctagtttttgcggtgtttacgggttctcaataatgtttaatagctcgcaaaagatggccattaccgcgggatttattggggccattgcgaatacattgcgccttgaactagttgacttgacagcaatgccgccggccgcggccgccttttgtggggcgctcgttgccggcttgatcgcatcggtggttaatcgttataatggttatccccggatttcattgacggtaccttcaatcgtaattatggtcccgggattatatatttatcgtgcaatttatagtattggcaataatcaaattggtgtcggttcactatggttgacgaaggccgtgttaatcatcatgtttttaccgctcgggctatttgtagcgcgtgcgttgttggatcacgaatggcgacactttgattaattgagtcgataaagttagcggttaacaagtcatttagtcactagatcagttaggtctggtgactaaatgacttttttaaatggcctttgactgaaaatttaacggtgacagtttacaattaagttatcaatctagcaggggggcttggtcatggaagggattactaatttacggtcactaggtggttatcgcaataaaaatcagcaggtaatcaaagatggtttaatttatcggtcaggacaattgaatcaattaacaccggcacagacgcagtatttagcaaccacgcttggcattacgcgaatcgtggacatgcgtagtgctgatgagcgtcatcaatttccagatgcgacatggccacacgtccagtatcacgtgctggatgtgctagcacaagtcatgacgaacgatgcaagtttacaatcgatgattagtagtacgggggcggtccatgaccgcatggttcagttatatgaacagctagcgttagatcctactgcccgtcaaagttatcgtcaatttatacagctactactggttccagatcagccactactgttccattgttttgctggtaaggatcgcaccggcgtcggggccgccttatttctaaaaattttgggcattagtgacgagcaaatcatggctgactatctgctcacaaatcaagcacgtgcagctgctaatcaacaaatcttggcgacgatggcgtcgcaattatctgaggagcaacaacgggccgtgaaccaggcattattagtagacactgattacctgagccattactttgaagtcatcaaggcccggtacgacacatttttaaattacttgcagacgggtctagggctaacctcagcggaatgtcaacagttacgcgaattatatttgactaaatagtcaataatataaaggcgcaaaaaatcacaccaatactcacttaaggactaacctgggtattggtgtgattacttattcatgggtgtttgcgttgtccgctgacaatagtcggtcaatcatctgattgccagcctgtaaatcggcacgttgataatgttgggcacgaatacgcattggatcaccaccatgatagtattcgtacatcaattggcgctgaccaaagccagaacttgttaaatcgaaggctaagttcaacaagcgcgtgcgggctttagcggtggctcggtccgtcgtgagtgcctggttgaggattgtcgcattatcgccgtcaaattccgcaaaacttggcacgccaaccatggaaccggccgctaagtgttgagtcacgcgcaaggcctcgtcatagtattcgggaagggtcgagcgaaccgcttgcaaagcttggagactgggcgtatagataccgaattcgtccagatgaccgttgtcttctgaacgggtgatggtacccttgatgagttccagattagcggttaaccgaccgagtttttcttggacacctaagaaaccatctaatcctaagatatgagcaatccgaagcgctaaactggttgctaactcaagcttagtaatacctcgaacctcatcttgatgggaagtgtggctaaacatgcctgaatcgatgaagaaacgattactcatttcaacattattttcaacaaatacttttgaccacggaataaaggcgtgatcaaagacaatgtaggcgtcaatctcatcaagggcgttgctgagtgggtaatccgtaatggaagcggtgggatgatttaataatttgcgacaaatgatcttgacgcccggattattgagtggcgtagcaaaggcgacagcataactactatcgccgttttctaacaacagttccggcggattaaagatcaggaggtcatcagcaattggggccatcgtattgaccattttggcaccagaaacaaagattccatcttgattacgttcaatggtatgaatacccgcgtatccagacggaatggcattgatggctttttgacggttgagttgtgggttttgaagcgcatggctaatgaagatatcgttagctttgaccgccttagcgtaattgcgggcattagctgcaaaatcagtatattgattttgcccgaggaaggcagcgcgttctgctaagacggccatcccagtattaagaaaatccggtgtgcggcctaacatgccgctgttactttgcgcaatttcttgataagcacggtgtttttgttgtaaatcagcgacggtgcgtggcactttgaaagcaatatcgtagcggtgaccattttcctgataagtatgtacttcgggatgggtgtgttgcaggtcatagtattgattattgagtgctaaagttttacgaaaaatgggcacatcggcgacattgacgcggtgaccatttagatagaccgcgcgcccgtcattgagttgttcgatagtatgcatgtgtcgttccccctaatgaaagttctattccaatataccactaatggaagcgaattcaccagtgctgattggaaccctatttttactgaacgggataaacgacgtggaagcgttccagaaccatttgtgcagtatggggatcaaagcgctgatgctcgctttggtactcctgcttgaagaaggcatcatgaacacggcgccaataggcataagtacgatcgccttcaccttctaagtaagcgtgggttgcatcgatgtccaagtaaggcgtaatcatgacttgatcggtccgggtcacacagacaggctgattatgagcatctaagatgacgtcataagcgcccacttttggcagtggttcatcagtttcgtataggtcataagcgctggtggtagccgtttttgtgccagttagtacgagctgtgcgagtttatcaggctcgctgccaaactgataagcactttgtaatggggtactttgtgtcaatttgagcgtcgttttagcttgttcgaaaaaagattggatgtccattattatcacctcttaattaggattgactttaagtttaacataattgcccatggctcaagtaattagcgtggtataatgactctatcttgggtaattgcaggcgatacccagaccaaacattgccgttgtggaaaggactaatcatgcgaattaatgtgttgcaacatacccccaatgagggccctggaatgattgccgattgggcgcatgcccatggtcataccatgtatgtctatcacccgtatcaattcggtgttctcccaacggcggatgagacggagatgcttgttatcctcggcggaccgatgagtcccaacgatgcgctgccatggatcaagcaggaacgagacttgattcaacaattattggaccgcgatatcccaatgtttggtgcgtgttacggcgcgcaacaaattgcgaagaccttaggatacccagtcactaaggcgccagctaaagaagtaggttgggcaccgatttaccgacagagtcccgtgattccggggattccagcaaaactgtcggtcttgcattggcacgaggagatgttcaccgttccagccgaagcaacactgttgttctctagtgatcgtgtgaccaatcagggcttcgtatggaagcatcgggtagtggggttacaatttcactttgagccggctgcggacaatgttcgtgaaatggtcgtcaatgactatcagtatattgcggggtcggtcctaaaccaaaccgcagcagaaattttacaaacgccggtaccacgagagaatcaacaagttctgaatgcaattttgaattatattacggctgaataaaacagttaagaagagaataagcaggttagtaaaaatgtcggtagtccttgacggggctaccgacatttttgttcagaaaaccaaacgttaatagaagccttgaatttgctgcagttcttgcagataggcagtttttaacgcttccggataaataattctaacgttacggccaagtcccagtaaatagtcgaccatataggctaattcatcttgattataaccaccaatgagataatcttggtcgttctgatgtgttaagtgcatattaggataattattcttttgtacatgttcacggcctagaggtgttagtgcacatttataacgtatattgtgatgatggtgatcgtaggaccgttgccgttgcgcgagctgtttccaagtataccgagctggttgctcactggtttgaaatgctttgatcgtatcacagcgatagatgccccaagcattgttatcgagattgacgccactgaaaaaccaaatgccatgccgatataataaatcaaaaatctgaaacccagctgtcacagtagtcatcgttaactggacaacattttcatcaaggatagccgttaataaatcacttaaatgggttggggcatccaagttaggaattgagtagtagttaaccacacgttgcaatttggcgacctggcgctggttgcttaaagatagtgttgccatgagttttttgtaaattgttttgagcgtttttatgattaagtctgaaaatgattttaaggtatcggtagttgtaggctacggataccttttttgcgatactgcacgggaaatgggtcaccactactttaaagtgattgcaactatggaaagtaatcagcctgattttggtgattaacattggactaaaacacgccgaaattcatgcatatttaacgttagtggcagacctttactagccgttcagtgctgagaaccggtatactggaagcagtgattcactaatcatgaagggagcccaatatgaaacggattgtagcgggaattattgcccacgtcgatgccggtaaaacgacgctgtcagaagcattactataccggtctggcgcgctacggcaattagggcgcgtcgataatggcgatgcttttttagatacggatgcgcttgaaaaacagcgtggtattacgattttttcacaccaagctaatttacaatataaagacattaatttaacactcttggataccccgggccacgttgattttgcgacccagactgaacaagtactgtcggttttggacgtcgcaattttagtcgtttcagcgactgatggtgtgcaggggtacacgcggacgttatggcgattattagcccgttatgacgttcctaccattttatttgtaaataagatggatgcgccggggacggatagcgaccaattgatacaacaaattcaacagacattatcgcctggttgtgtggcgtttaacacgccgggagccggggacacgttggaagatcggccagtcataccaactgcggcagttgaagatattgcgatgcaaaatgacgaagtgttaacggattacttagaaacagggacgttaagtgatgccacgattcggcagatgattcaacggcgggaagtttttccgtgttattttggcgcggcacttaagctggacggggttgatgcgctaatggctggtcttgattattggacgacgccacaattaacgcgtcctgaatttggcgcgcgggtgttcaagattacgcacgatgaccagggtgaacggcttacttggattcggatgaccggtggcaccttacgacctaaagatatcgtgtatgatgaccaaaaagtcaatcagttacgggtttacaacgggactaagtatgcgaccacgtccgcgctgacggcaggatccgttggtgccattaccggtctaacgggaacgcggccggggcaaggattgggacaggcagcaactagtctacaacccgtcatgcagcccgtactgacttacgcacttgatcctcagcgtgaggagttacacacctgcttagcagccttgcgtcaacttgaagatgaggatccacaattacacgtgacttggtcagaaccacttcaggaattgcgagtacaggtcatgggaacgattcaactggaagttttgcaacaaatcttgcaggatcgttttcaactgactgtaaagtttggaacggggagtatcttgtatcaagagacgattacccaagctgttgaaggtgttgggcattttgaaccgttacgacactacgcggaagtacatttgttgctgacgcccgcaccgcggggaagcgggcttcaatttacgaccgattgttcattggaagtgcatggccgaaattggcaacaccaagtcgtgtcaaacctccaagtcaaaacacaagtgggtgtcctgattggcgcaccactaacggatgttaaggtaacactggttagtggtcgggctagcaatgttcattcggttggtggtgactttcgtgaagcgacgtggcgcgcgttgcgtcaaggcttgatgatgttaaaacaacgtggtgattgtcagttgttggagccgtggtatcggttccgtctagaagttggtcaggaacaagttggtcgggcgatgactgatattcagcggatgaatggtcagtttgacgcaccggtcgctaatacaagtatagccacggatgggactgacctgacgacaattacaggaacggcgccagtagcagcgatgcaggactattcacagacggttcgagcttacacgcatgggcaggggcaattggaatgtatcgtggatggctatcggccgtgtcataacgagatggctgttgtcgataaggccaaatatgtccccacagcagatttagaaaatacaccggactcggtcttttgcgcacatggtgcgggttatccggtggcttggaatcaagtgccagagatggcgcacgtcccgtacgtttattcgaatacggaattggcacattttaaggcgtcatcaaaatagaaattgaggaaattcagatgatggatgtgacgtttaattcgacgtttgcggtaaccttgcaacatgagttgcaccagccagtattgagtttgccattgtcgctacaaatcggtgatttaaatcgattgacaaccgatgatccagcacagcttgctatcatgtcacacagtaccgatgccacggttgtcaagcaagcgttggtaacattaaagtctcaagttgagcaggggggcgtgctacgagtatggtggtctaccatgcccgatgattggttaggatacgactggttgtgtcagcagttagcagacacagacgcgcaattgagacaagtgatggtaccgctaagtcaagtgataactcggccaggtctagctttacagactttgtcggatttatcggaagtattgccagcggatattgcgcattacttacagttggcacaagacgtttctgaggacgaacagcgtgctcatagttatgaatggcaagcgctcgtggtagaaaatgcgccgttacgggtcaatcttaacgggcacttagtcagtgccccagcggacttttatgacagcttgttagaacgccaaatacaaccgggacgcccaattgtgcaaattattggtgagatgctgatgcgctactcactgggcttgccagactggtggtatcgtgcccggctccaacatatcttgtcaacgagaggatgattaatgtgaagaaaattgcgcccctgttcgttggcttaggggccattagttttggaattccggcgtcactatttaaaattgcgcgtcggcagggggttgtcaatgggccattgctattctggtcctttctgagtgcggttgtgattttaggtgtgatccaaattttacgccgtgcacgtttgcgtaatcagcaaacgaattggaagcaaatcggactggtaattgcggctggaacggcttcgggatttactaacaccttttacatacaggcgttaaagcttatcccagttgctgtggccgcggtaatgttgatgcaggcggtctggttatcaacattactaggagcagtgattcatcatcggcgcccctcccgactgcaagtggttagcattgttttggtattgataggcacgattttagctgctggtctgtttccaattacgcaggcgctctcgccgtggggcttgatgttaagttttttagcggcatgctcgtatgcttgcacgatgcagtttacggctagcttaggcaataacttagacccgttatcgaaaacatggttactgtgtttaggcgctttcatactcattgctatcgtgtggtcaccgcaattagttacggcacccaccacgccagcaacagtcggctggggagtactgattgcattattttcaatggttttcccactggttatgtattcattgtttatgccgtacttagagcttggcattggcccaatcctttcttctttagaattaccagcctcgattgttgttgcatttgtactgcttgatgaaactattgattgggtgcaaatggttggcgtggtcattattattacggccgtaattctgccaaacgtgttaaatatgcgacgagttcggccatagttcaggtcaataccaaactcaaaatgaacatgttgtactggattcatttttgtactgtgttttttgtttcacgtgaaacattcatctaattgatgctctttatgaatagatggtggataccttatttatataaatgattaaatgcgcctcacttggggacaacttgaattgaaaggtggtcaggctggtggcgctgacctatcggatcgtccgcgctgaagcagacagtgattttgggaaaattcgacaattatattatgagacctggcaatcagcatatcgtgatttgatgcctgcaagttatttacagcaattgacgccagcaacttggcggccggaacagcggtggcaaaatatgttgttgaagttgtgggtgtttgcacatttgctccggccagacatgcaaactatgaggggtggggcgaactatattcgctatatgttcacccacactatcatcaaggcattggtcagcagttaataatccaggcccaccgtcgcttgaaggcggactatccacagaattatctacttgttctggcaaataatgctgtggcccagcgcttttatcaacgtaatggatttcacgacattggtcagatttatgtcgatcatgcgccgttttgtgttttgcatgagcggatttttgaagattaacgcaaaaaaacgagccttgtgcccgtttttttatagtttagcaatcaattggcgtgcgaccgcgcgtgctgaaaacgggttttgaccagtaatcaattgaccgtcagtaattgcgtattcgcgataaaatcgatgctgactaaagatagcaccgtgagcagtagctcgttcacggttaaggaacgggacgacccgttttttgccggcaatcagctcttcagttgcggtaaagcccgtaatggttttgccagcaatcaagtattggcccgtttggtctttgatgtttaggaggccagcaattccgtgacaaacggaagtcacatatccaccatgttgataaatggccagtgcgatggcttgtaactcagggttgtctggaaagtcccacatcacaccgtggcccccggtatagtaaatagcagtgtaatcatcgggatcgacctgactaggcttgagcgtgttcttaagggcccgattaatgaagtcagaatcttcatacacggccattgtggcggcatcggtatatttcatactacgcgggtcaaggggcacgaagccaccattagaactaacatagtcaacggcaatttgggcttgctgcatttcatcgacgaactcagcggcttcacctaaccaaagaccagtcggatcgttagttccttggtaacgggtgatattggtttcgacaattaaaacttttttcattgatcctgactccttaaaaagactgatttgaagttagctaattaggttgaatactgataatgattttaccggtagcatgaccggaatgcgagtattctaacgcgtcgttgatgttggtgaggggaataatccgatcaataaccggcttaataacgccctgttcaattaattgtcgcaggcgcacaagttgctggccactaggttgcatgaacagaaacgaataggtagcttgggcttgttgttccagtcgactcagttttcgtgttgctagccctaataaccattgtttccatattggtagtccgtaatccttaccaaaacgcgcgtttggcactccggcaatgctgacgatctgaccgcctggtttgataatctgaaaagcggcctcgagggattgcccgccacgagtatctaatacggcatcgtaattggataatacatcagtaaagtcttgctgatgatagtcaatgattttatcagcacctagtgattgaacgaggtcaaaatgtttcgcactggtagtggttgcgacgtaagcgccgaaatatttggccagttgaatggcaataatcccaatgctacccgaaccgccgggaatgaaaaccttttgtcccggctggatgttcattatatcgtgtagtgcttggtaactggttaaatctactaatggaattgcagcggcttcttcaaaattaagattggctggtttcagtgcgatggcttgatgatcgatggcgataaattcggcaaaggttccaattcgatctttgggtgcgcgaccgtaaacagcatcaccaactttaaagcccggtacttggtcgccaacggcagtaattacaccggcaaagtcactgcccataattagtggcatggtgtattgtagtaacaatcttagatcgccatctttggttttcaaatcgattgggttgacactggcggcaacgattttgacgagaacatcggtgggagctattgtcggaacagggacttctgtcaccatgggggttatttgcttgtatttagtaataatggcagctttcatagtggactcctaacatattggtttaaatgtttaacatcttgaacaaagcatgctgttgattctagccgcttacttacaaaaagtcaacgattaattcttgactttcaattttagcaagcgttaaatggtttaagaatacgaaccgtaattggaaaggtgtgattttttggcagaacgaacgatggcaatatttaagaagggtgttccgatttttacaattcttcaagacgaaaatcggcaacgaattttggtgatgttgtgccggactgatcagatgacggttaaccaaattacagcgcagatcgccttatcacgaccggccgtatcgcaccacttgaagttgatgctggatgccggcattttagcggttagcaaaacaggtactgaacgttattaccgcgctaacatgacggcgacgctaaaactattgaaggccctcactgcgtcattagaggccgatttagccaatactcagtctgtagacgaataaaaactgaatcagagtgaaaaagctggtacttttgaaatgagaggcgtcattccaaaagtaccagcttttagttcacttatgcagttcggcgcactgaatcaccagtacctgaaacggatggcgccatttaatgattatcagtgagctaacgacatgatatcgttattattaatttgaggatggcacttgaatatctttgaaggtgtgccgataaagtaaccagccaagtaagcacgttaagacatcagcgaccgcttgagcccaaataataccagttagtccaaagaactgtgccagaataacgatggcgatacctagtaagattgcttgccgcgaaagcgccatggctagtgcactcaaacccgcgccgactgattgaaagacggtcgtgaacacgaggatgaagcccactaatggtgtcgtaatcaacattgctcgcaacatttgtgtacccatagtgacaatggctgattgattcataaatagtttaataagttgaggcgcaaaaatcattagaataatcgcacaaatggttgcgtagccaccttcgacttttaaatcgaagcgcaacgttgcccgtagtctttgccaatttttagcgccgtacgtgtaaccaactaaaggctgggccccaaaagcaaagccgaccatgaccatcataacgaccatgtaaactttttgaacaattcccatggccgccacggcttgggcgccgtatgcggctaagtagctgtttaagatcatcatgccaaaactctgggttaggttagtcagtgaggctgggattccaactgcaacaacggctttaaaggtcggtcgcgagatatgggctaactttggtgctaaggagagcgttttggctcggcgcataaaaaagactaacagactggtgttgaccgcgtaccccaaaacgttggcaaaagcaacgcccgaagcaccccagtgaaagccaaataagaataagggatcgagaataatggtcagaaccgtcccactgatggtcgcaatcatggaaagttgtgccagaccctccgttcggataatgttaccgggaaccagtgaaacgatgataaaggttgatcctaataccaatatacgatagaagtccgcaatgtagggacgggtagctgcagtagcacctagcaagcctaaaattggttgttcgaatagtaataataaggctgtcagtactaagctaagcgcaatcgcaatgtaaaaacaaaagctactgatacgtgcactttggtgataatcatgacgaccaaggactcttgaaataacggcactcccaccgagaccaaaaatatcaccaactgctaacataaacgaaaatagcggactgccgagggcaataccagcaactaaatcagcattaccagtttgagcaacaaaaaatgtatctgctaagttataaatcatgctggcaaccatgccaagaaccacaggaaaggctaaatggaaatacgctttgggaatcggggccttctcaaataaatcatccataaaaataagtcactccttctctgaacggtcggtcgaagcgtgactagacgaacagaaagataatataagttaatgatacgcttgactgtcaagctgctcaatgcaccaaactgataaggacggtcagctaaaggaacgacaaaaaaagcattgcccagtgtttcagcggcaatgctaaaaattaacgtgaatttttaagagattaacgtaagtcgatttggtgaaggttagccggcatctgaccaacatgatggccgaccgttcctgcgtgcatcgcttgtgcgccattgataaagtgcacaccagtggctgcaattaatcccattcctaatactgtaataatacttaataccatcattattcacccgtttctgattatttctgcacttctattgtagcgcttacattactattgtcatttgagttgtattagaatggaattaagtttttcactttttcaggtggacattagtattgggatagaataagtacgcattgtgcgagttaatttgtcatcaatcttgattaaaacgtgccaaacagatggattcctgttcgtcaacaatgatcgtcctattccgacctccggggctgggtgacaattgctggaacgtaagccgacgtcgatttgagctaacgcacaacccgcgtcatctcaaatacgagtcttattctaagccggaagaaaatcacttccagctaagaataatttggctactgagcattgtcacccagcccctccagtcgggaacccgctcgaatggctgatgaacagccactgaacttggtacaattggtcgcggactattttgataatggaactttaaacgagacgttagggttacattaaccactttgttgagacgttcgattattactatggcgattccaaaatagtgagctatcacaatgtcattttctacctgacagttgctcgacaaaattactgtttatgaagaacaatgacaaattcatcaaaagttgggtgcctcactgtctgccattcgaataccatctcgactggaaggcgtttctgacaatgcccagtggtgaaatttcacttagcaagcgtcttttgcttggttagtgaaaggccagtatttaagacgtgggcttcggcttaaatctgtgcccaccacgttccggcaattggcagaaatgcctggaggtcggtgtaggacgcgcaccctaggaaagtttatgctaactcgaactgttcccagcgaacctaagctggctgcttttgaatttaaaaaatggcacattttaatcaaggttaatgcgaaatagtagctagcataacgcgtaacaagtaaaaaattagtaacgaaagtgagtgatattttggacgtgcaagaaggatacatgccatttaatggttatcagacgtattatcgaatcgtaggggatcggcaatcaaataagacaccgttagttttgttacatggtggtccaggatcaacgcataattactttgaaggatttgatgacctggccgttcaaacgggacgaccaatcgtcatgtatgatcaattaggctgtgggcgttcatcgatgcctgatgatgatcaattatggcaagccgcaacgtgggtggcagagttgcgggcgttacgtacgtatttagacttacccgaaattcacttactagggcagtcctggggtggtatgctagctattatttatggttgtgactatcggccacaggggattaaaagtttgattttagccagtactttgtcttcagcccgactgtgggctcaggaacagcatcggatgattcggttaatgtccccagcggatcagtcggctattgcgacagcagaacggttacaggatttcacaggtgctgcctacctgactgctaatcaacattttatgacgcaacatgcgtcaggcccgattactgctgatgatcctgaattcctacggcaatcaaaacgggtggggaccacggcttataatgtcgcgtggggtcccaatgaatataatccgactggtacgttagcggattatgagtataccgaccgattacagtatttgcagatgccaactttagtcaccagtggaacggatgatttgtgtacgccattagtcgctaagaccatggtcgaccagttacctcatgcgacttggacgttatttccccgtagccgtcacatggcgtttatcgatgaaaccacggcctatatgacgcgattgagtcactggttggcagcccatgattagagaaatgagcgtgatcatttcccgggaaataatttgctgaatagctagattgagaagtttatcagcgtgctctgattttgtttggctgtcacgataatggttattaaaaggtttaaagtagaccaaagcgcctgtagaagttagccttctgcgggcgctttggtgattgctgtgatgatgtttaatgttgatagataaagacgaatcgattggccgtcgagcgcttctcgtcaaattgataatcgggatggtcaaatttgcgaatggccgtcacatcatcgatttgatgttcagccaaaaaacggaccatggccccacgtgccatcttagctaatgtggctttagttttgagtttgccgtcgataaggcttgcaaagacaatatcaatcattgattgatgcggagctagataaggtgcaatggtcttagcatattcttgagaagcaagattgataattggttctggccgcggcgtcagtgcctgatagaggcgatcgccccaaaacgcatagaggttcttggcttgaccaacagccaaccgtgcttgcatttctaaccgataaggaacgataccatcaaacggtcggagaatgccgtaaaagcctgacaagattcgtaagtttgcctgaatatagtcaagggctggctgggtaaagacgtccggggccatgtaacggtactgaataccgctgtaactgagaatagcgggagtcagattgcggttcaggtcaattttttgaagccaatcataattaggttgggctagtttgtcactgcaatgccataaggtcctggcctcaggataggtgaggtgttgcagttgagccagtaattgttgcgtctgatcaagatagattggttcagttagagctggaaaggcatcttggtcgataatcattttttccgcaggtgcaatgatgattttcataaggtcactactttcgagtaatacagagatggaatgaggttgattccgtctgttacatatatagtatcgtttacgacctgttttgtcattttcgccccataactcgctagcctcaggtatagacgcatctgaggctttcacttatacttaggctaatagcgccatacagaaagtgaggcgaaccgtttggccgttaaaatctcaaaaccattgaaacagttattgaaggcaagtgttttaggtcgcaataaaaaccacccgttagctggttggaatgtcttaacgattctttaccatgatggcagcaacgggacgccattaaccctaaattttttgctcgataagtataatcgaaattatttagagaccgatgaacgtcccttgagcgatgtggtactgaaagaggttttacgagttatcagtgaagatgcacggttggtagacgtcgctccccgtaagattcggatgcagatgcgtaacggcggtttccatatgcaacagtcgcatgtttataagataactagcagtggaattgaatacttatctatgatgcaaaaagtagtcgatgccgaaagtacggtcaccgctaatattacacgaatcaatgagttttgcgatttagtgcatacgttgaacgcaccccaagaagatttggtcacgactagactctacaatgattttcagaagatggtcacagcctatgaagatgtcatgaaagggatgcataagttagacgaagatttggacgaattggcgaataatttggcgtttgagcatggtagccttgcagctcaacggttaaaagcgatgttgaatgataaagcgattccggcatttagtcagttgcttaatcaagggccgttagtacgtgaattgaccgattcagagcggtttagtagccaagttgctcacagtcaacaaggtagtgatgatttgaatacggccaatgccattggggatagtaatgaactagcaatccgttatcagcgcacacgtaactacgttcagcagcggttgagtcagcttgcgctgagttttgatgctagtacgagtgcgattgatagtagtttggatagcttatacttattatttcaaacgataatgggcgccaatgaccggttaagccaggaatacgatgcgattcaaagccaaacagtagacattcagcaattgaccaagcaaatcgatgccttactaccacactatcaaaagcttgtactcgaccggccaattccacgacatctagcacaggatcgcgagttagatgaccaggctgactttttagaagcaacaacgatgggaccagtaaagtacgcggctaatcgccttcaacgggttgttttaactgaagcggacaatccagacatcgcggtcgaagaagtcaatgatgatactgacgcggtcatggaagccgctttggcagaattcaaacaattagtcatgcgggatgcgacgcatggagtaattgatcacgcgcttgattttcattcacaactagctcgtgatgaagtcgtacgcttatatagcgctactggctatgatcattacgatagtttcgcaccatttggtcggaaaattgtgcgcgtgaagttagttgcaggtcatacgccaatctcgttacatttaacgggtgaagattatcgggtctggttaccacaaggttttgaaatctggtttgaagaggtgcaagctaatgcctgaattacaccaaaatgaacgtctgattattaatcagttaattgatcaaagtgtgtttactagcacgcttcaaaagaacatgaccaaccggaccaaggaggctattcacgcacttaaacgcccccaggtgcaacagcgagtaaatacgtacttacgtgatctagttggtgtgctacccgagaattaccaagaaaatttagtgttcttgttcggacgaccgaagcttgaatcggaaaccgttcatctattattggcaacgttaaaaactgttatcaacttaccggaaatgcaaccaggcgcctcacgaattgtttctacacaaaccattgttcgacttgtgcatagtgaagtcgttgcgttggacgagcgtgaagtactacggcaaatcacacatttgtttgttgatcggtttaaactttttataccggatacgccggaagtacaaaataacgaaatcacgcaggaagtgacagagttttgggatattagtcccgactttaactatgttgcacaggcaatcgtcgattatttaacacagcagcgactcgcaccagacttgacgcctgttcaaatggttaatcgtgcattattggttcaacagtatgtaagtcggacacagcaacctgacttattccagtcgttagtagaccatcgtgacacgattgctgcacaatggcagcagttacaacgatttgatctggaagttggcgaagattacgggttgttgcttgataagacgcggcaaccggtgacagctcgagcctttgtggtggggattgcggttgcacagcaacttggaattgggttaccagataatgaactcaatcaacttatccggaccgtggcaccaacggttattggcaaaagtacggttaatccgaccgaggtcaagaagacattactcgctaatagtttagttgaagaaaaggatgggttttatcatccaaccgcattaatcaagcggtttgacgttgcaactgaaaatgaggaggacgcggttcatgccactgaatgaacaattagtaccagttagctttcatttgcgcaactttaataagtatctcaaacttgatttacaagcgtcacaacgcggaaacctaacattgattggtgaaaatgccgttggtaaaaccacgttagccaactgtttctttccaatgttaattgatggttcgatcgcgacaccgtcttttaatgccgctaagggaacggatcgactagataaagcggcccgtaatagcgcccaggatgctcggaactttgacagcatgctcttaggatggggaccagacgccatgaaggtgcggacgggttatagctatattcattttaagtccgctcggcgccaagcgattacgggaattggagcgaccaggacgacgggcaatcccagtaaacctacttggtggttcctaattgttaatagtgatccgcaagcggcactggatgtcatcacaactgatcatgacggtaagtgtctggataaatcagcgttcaagcaggctaacgccgcattgggtgatcagctgcaaatctttgatactgcggccgcatatcgtgatcaagtcgcgactgtcgtttatgggtttgatggcggtcaggcacttagtaagttggcttcagcgtatcggttattagcatcgccgattctgacggcaggtaatgccaagttcacgcctattattgaagccctaaaaaatgctcaagaaggtatcgatccgcaaacaatcaggcgtattgctgatagtcaacgtgaggtcaattatacgaacggcttattagaacgtttaggccgtgtatataagcgactaatcaaaattcgtaaggatattttctggggaaatttgaattttttagatagccaagcgctcactaattatgcggatacgcaacagcgattgacgaaagctcagacaacgttagatgaagcgcatcgtgaaattgaagcttgtgaccagcaattggtcacgattcaagccagtttgaagacagctagcttacaagtagatgcattgcgtgaacagcaagccgtacaaaagctaatcaagactcagcgcgcacaattacagcaaacgattgccagtttgaatcaacggctggccacgtatcaggcacagttacaacagctggatgatgccaaacagcagttagccgattgtgtggccaagattgaagaaatcgaccaccagcgtaatgggttgaagacgagtgaactcagtccgctgcgggctaagctggatcaatactctgcgacgctgcccgagttacgtgaagtgatgacggcgcttgagttagttgatttgaccgcgcaactgcagcgttacgttcgccaccaaaagggttatcaaaaacagtatcaaagtttagtggatcagattaatcagggaagccaagatgtccaaatcgttggcaagatgaagggacggatggatcaagctatcgaccagcacgcccaaggaccattaagcggccggttacgtgataatttgcaccaagataaccatcagattcacgatgatggtgctagcgaaatggaccagcggatcaaacaataattgcccagcgagaccagttgttgacaacgcatcccgacttgaaagtcatattggcaaacgaaagtctgttaggtgatcttgaagcattgcaaaagcaactccaacaaattgttactcaattggcggcctatgatcaggatgaacaacaagtacatcagcaacaaacggcggtaaaagcacagattgaccggttgcaggcgctaatggaaccagcatttgacccggctgcgattaaacgggatattaccacgtctcagcagcaattagatgaattagtgattgatccacagctggatcaaaaagtcgcccaggcggttacccaccaacaaagttatgaacggacgactcgtgaacttgagacgcgtaagagtaagaatcaaggaaaattagattcggccaaagtcgaagttgaagattatcaggaacgtttggatgatttgacggtgcggattacgcagaatttgaaagttttacagccatatgttccagctgacgaagcactggatgatgttgaagatgtcctggcttttgtccatcagaatcgtagtatcgtgaaggataatgcgtatactgatttagtcgataaaattagtaagggaattcaccggaacggcgacgacggtgttgaccataatgcaatcgataccgtttttgaggaacgtggccatggtgcagaggcgagtcagatgcggcagcaacggtcaacacgcgatcacgagatgattgtggtagcgtttgacatcaaccatgccattgcactgattatgacggatcaagaacacgtcacgaaaaagctagcccagcttcagcaaggcaatgacgttgcccagagtacttacattgcggcagcggttgatcgcatcgataagcaatataaattaatcgagcagtacaacgtgatgctttcgcaaggcacgcaacgtgcgcagagtattaaattaaagattcggcttacacccactgaagtagccgacgtggttattgcggaagcccgtaatgcatttaaggaagctcgaccaaacttagtagcggaggtccaacggcgattgaatttattggctaacaacacaacgttagcggatgatgaagaggcatttaatgtggaggcgcaaaagttactagatacgcgtcaatggtcggcattcgaagtcttgatcaaacggcggcagagtcgcgatgatgcctatgaagttgtggatgataagtttgttcaatccggtggctctggtgctgaaaaggctcaggcaatggttctaccattgttgctagtacctaagatggtattacaacagtctaatttgaaagatacgccgtacttagtgatgtttgatgaatttgctgataagcttgatcctgagaccgcgaagtcgtttgcacggacgattgccaattttggctttaactttattgcgaccatgccaagcggggcgcagaataaaattttggcagatggcgttgacaatattgcctatgaagtgttggcgccagcccagcagggtgatggtaggttccatgcgaaccgggtacgaccagcattgatctggcaaaaagaggcttatgatggatcgttatcttgaagcgtaccaaacagtaacgggtaaaacgccaccagttgccgcagcaaagttgacaccgctatttgatcagatgcaggctggtcaggttgtaccgccgcgtgggcaacaagctgtcgagctcgggtttacagcccatacgttcaatgatcggcgggaaaacccagcaatgtacgattattaccagtgggtgacgacgcacgtcataactgggccgattaatgagctgactgctaaattaattggaatggcgtttacgagtaccaatgttatcgaaagcaatctaccacagccgctcacgcttaatccgtggcaaatcacacaacttgaaacagcactaattacggccaagcaagcggtaattgttgaaaataatggtatctttatttggcttgcccatcggcatcctgagtggccgcttattaatcaaagtggcaatgactttaacgagtcttccgtccagatgattcaaaaaattgaacaagctggcgttgtgttaacttatctgggtgatcttgatagtactggtatccggattgcagcgcagttattctcggtgctaaaaaaacaccagttgatcaatttatggtactacaaacgccacagcgggtcgttcaatggttgagtctctatggaaaagtcagttctgagcgaacacgttcggtaaagttggaaccgcaactatttcaggaggaagtaaattcgatccatgtttttggtcggtttgtagagcaagagcagttgattgagccatatgaacaactgattgcagattggctggtatagttacgggtggcaaacctatgttcttgtttggcgcaaattacggtataatagatttataaatctgattatcgaaggagtctatgagcatggatatttcactattaaaacaagtggttcaatcaactaataagattgccctcagcacggccgtcaataatgaagcagatgttaaaattgttaactttgtctggtacgaagcacaaccagatacgctatacttctcatcagttaagacgagtcccgctttgaaggtttatgaccagaatccggatattgcattcattacgattcctaatgatggaacagcgggcaatccatatctacgagcccaacacgttaagttacaacggtcaactaagacgatgaccgacttgctaccccaatatttagaaacagttccgaattatcaacaagtctgggatgctattggatcgacactcgttgtttttgaattaaaactaactgatctttttgttgacgcgggtgttggtggcgagaagcaaacactgacttttaattaacactggattcctatactaaaagcgtttcaaggccggcttaggttaagctatggtcttgaaacgctttttggtcgggtaattttaggagcaactatgaggcgttacttcacatatgcggtccgataattggcggcaccgctgaaattattatagatgacgccctttaagtgcgacttaacgagcagatgggaacggccttcgtagagtggggtcacagcctgatcagttagcgccgttttagcggcttggactaagtcttgatagcgcttggtcgcgtttaaagcatcgggaccctcggcagcttgcatggcctggtcgtaagccttgctttgatagtggcccatgttggagttgctgtcgccagtcaaaattgttaatgattgtgaagggtcggcaaaatccatactccagctagttaaattaagctggaaggctcccttggaaactttacctagcattgcggtaaatggcattgccttgattgttacctttagtccggggaggtgactggtcaattgtccctggatgaattcagcgacctgatgtgagttgtcatcatcaccacaagtaatcgttaacgttagcgattttttgcccaattgtcgttgtgctttatgataggcggctcgagcctggttgagattataattaacagtaccatcaacggtcgcatcattgacaaaatcggtaccagttttaggattcttagccatattgcgcacaccaaagcttttggcgggaagcgaaccattttctagaactttgttggtcagttgcgaccggttgattgctaaggataaagcggtgcggagttcacggttggctgctacatggtcatggtgattgtattgaataaagctgatttgaccacccgcaagtgttttgagttcttgattatttttattctggacactctgctcgccattaagtgttacactatctaacttattagattgatacaaattataggcagtcgtattggacttaataacctgataattgattgggtgcagtttcaccagtttgtgatcgtaataagctggatttttctttaaggtccaagtattattagtcccggtccagccagtaagcgtaaatggcccgttgtagacggtcgtcgcggctgaagtcccgtacttcttcccgtatttgttaacagcattttgattgaccggataaaaggtcgaaacagctaaaatctttttaaagtaggcgacgggtttgcttaacgtgattgttaattgatagtcaccattagctttgacaccaagggttgatggctttttcttgccggctgcaatggcgtcggcatttttaatgttcgtgaagacataggtgaattcggatttactttttggatcaagagttcgtctccatgaatagacaaaatcgtgagcggtcaccttgttaccgttactccagcgcgcatcgtggcgtaattgaatggtataggtatgaccaccattggtgacagttgtcttagtagccaaagcgttgacgggttggctctgactgttcaaccgatagagtccctcgtcaacttgggtgacttggctattagaaacgctgtccgtcattttagcgggatctaagctcataatttctgagccggctgatagattgataacttgtgattgtttagtcgtagctgggtgcgagtgggcgttgacggtaaacccgatgccgccaataatagccacgctgccgattgttaaaattaatttgtgtgttccggataaactcataattaaatcctccaaaaatataattgtatttggttagtttgatccatgagttttgccatcgtttcgtgaccatttattttaccccgtttttatcgtcaaaaaaaccgtccttatccagccaatgctgtgttaaggacggtttgataaccgcggtgccaccttaattgagtgttcgccaatttagcgattaaatcacgcgtacactcctactccataggaaactaacatttccctgacaactgacgtatgtcgcacgtctttccgtactcttaactggcgttaatttcggcaaagccctcggtggtccatttaattacctgcgttcggccatactctcagcaacgatgactctctgtgcgggcacgataatcttgatctccacctcattggtttataaggacgatattttgttgaagtgagtataccgcttttgaaaatcagttgtcaagagctggaaaaacattgttcaactataaatttagtcaaacagaaaacgatgttcgtaaataaaccgaggattaatatagtgtcgcgtggcattgattgcgtggcttttaataacggctgcaagcattaattactttcattatgcgcgaataaaaattataatgacatcaataatgtaaacggattcaatattgcggtgacaagattaaggagggctaaacatgagctttagagttgtagccggttatttcggtgaatttagtaatgaagcgaagcgggccaatcaagacttaggtgtaatcggcatgtcgtttcagtatcaatgtaatctcgtttatccagaaggggcggggcccaactttggttttcgaaccgacgcgcaagcgattgatgtgttcgatgcgttaaaagttggttacgatggtttcaaagtgcaagctggcctgattaaggcgatgggactagttgattatcaattggttggtggtcgttacgaactagtcggccatgatttccgagaattacctttagctgagatcaatgcgaacttggaaacgatgcccggactcttggctcagggaccgatgccagttcgatatgtgacttatcgtcggacggatgaccctattgacgcggttggctttagtggcaactgggcactaggagatagcggtggctttcgacagttaagtgagacgttggcagaaccaatgcaagcaccagtggcggcgctaattaaggcaattgatcaacttggtttaacgttacaacaaattaatctacccacaccgcaaagttcaacggctttgccgacacatttgagtgatgatgttcatcaagcgaacgttgacgtgtgggtggcgttaacacagccacaaggtgatgaacaacaagttttgcagaccattcataacgctcaagagtgtaatgaaaagttgtgcgaagcactgactcgtgtttatttgaagtagaatgtttcacgtgaaacatctggcacttggcagtccgttattttctttagtgcgttgtatgatatgatacgcacgaaccgtaacacatcttcacgggagaaaatatgttattagaaacttatcagcatcgttcatttatcaaacaaactggcaatattttaacgacaccgcgatcgcgcgaaacaccttttgatattggctgggacacagagattcgggcctatgaatggttacgtcagcagtatcagcaccgccgggtaagattaaatgctcaacatgcgttgatttgggcgtggccacaatcaacgattggttgcccaattgttccacataccgaccgccgggtagccattgtgcatttgtggctcgatatccctgatgacttggtattgttaatgaactttgaggcctggacgataccgattataggcgcgcgatttatggagaacgacactatttctatcgaacgtgattgggaaaagcttttcgatgaagcatggttgattaagcatgaatatgcagctagtgatgattggctggatcatcaggcggtttttccttacgttgatcgtgcttggatcaagcgcgttaagtatcttcgtggctatcgctaagctcaagacttagaggggagtggtttgatgatgacatcaacaccacggttattacaagccattcaacaaacgaccaccgcaattttaaaaacaaaccttgttggtatttacctgtatggatcctatgttttaggctcatataacgaacaggtgagcgatttagactatctgatcgttgttcggcgttcgttaacattagctgaaaaacggcagttaatgacagctaccataacgcaattgtggccattagcgccacacaagggattggagtttcacgtgctgttactgagtgcaacccagcattttgtgcatccttgcccattcgattttcatttttcaaaataccattatgaggattatcaacgggcaccgctagcctacctaaaagcgatgcacggcacggatcctgatcttgctgcccacttaacgattctccaagcagcgggacaagtcttacttgggccagctattacaacggtctttggccccgttcctgcgacggcctattgggacagtatcaagtctgatatcgcgaatgctgaaacggcgatcgttcagttaccaatgtatacggtattaaacctttgtcgagttcgcgcttaccagcaagatcagttaattatttctaagcaggccgggggtgaatgggggttacaacagctgccagcacagtggcagccattgatcaggcaagcgttagcagcctatgctggtcaacaggacgaacaggttatacgatggtcacgtccaaacttagtggcgtttgcacgaatcatgttagccgagttgggcttaaaatcagaatagtttgtgagtttaacaaaaaatgcttactggcgatcatccaccagtaagcatttttgtcaccaccaacttaaagtcggctgttataaatcaagaaactaatgtagcagttatcgccatcaggtaaatcatagccagtgttttcgttgctaccgtcattttcgtgtaaaacaacgaattcaccagaaccataatcttggtcgtttaaatactttactaaacgttcatcacattcagctaaagtcttaccggtcacaacgcgccggttccaaccacgatggatctcagtatttggattaagcatctcttctcaactcctcttaattataaagtcatcaattgcgcttgccaagcgggttgctgatcaagatcagcgcgcgttaggtcagcgtcgacttggtgggtactgttaaaaataatgaaacgttcaccaacggcttggacttgctggtagttatggcttgccataatgatagttttgccggcagcttgtagccgttgcagtagggttagcatttgctgctgagcggcaattgttaagccgttcagcggttcatctaacaataaaatttcagggttcaaggcgagaacgctggctagtgccacgcgcttcttttcaccacctgaaagttggtaagggacccggtctgctaagttagcacagtccgttaattgtaagcagtcggcgacgcgttgcgcaaccatggctgctgataaaccgagttgtcggggaccgaaagcgacttcctcagtgaccgacgtgttgaatagttgaacatcagtattttgaaagaccatgccgatccgctgatgaagttgttgtcgattttgggcatcagcgagataagtggtcgtaatcggctgatcgtgaaactgataagtgccactagttggactagctaatccactcaatagtcgtaaaagggtcgatttaccagatccattgggccccattagacagacaaagtcgcctgagttgaccgttaagctgaggtccttcaagccacacgtatcaggataatcatagcaaatattcaccaatttaatcaataccacgttaatgcctccaaaaaataaataatatccagacaataatcgctgggctcagggcaagataatcgcgccaatgggtacgacgcccggttgagcgcgcgtaatgaccattgaacccgcgtgcttccatggcagcgtatagttctagcgcataagtgtaacttttaagatataaattaccaaataatgcgccgattaaacggtatggatgagccgttggggcgaccgtccgcaattctagtgcttccatcgtcagcaatagatgttggccgagcattcgtaagtacgtgatggcaatggccaaagtcataattaatagatcagggcaatggagtgccttcaagccagccaataaatcttgaaacggcgtggttagacggtaatattgagcgtttgccagcattagactggttttaaggccaaagaataatagcgtggtgggaccggctaaccagtagctcggtaatacgaacagcatggccatcccaacactgattagccagcttcccataaaacggcgcagttggcgtggaggtaaccataataattggcacccaactaatagtgctaggccccataacagaatgagattattacttaaagcaattaaaatgacgagcaacaggagctgaattaatttgaattgcggtgcaacgcgccaatgagacgttgccgtgactggcgctggctgtgctagtcgactgagtaattggcgtaggtgacgctgattacgttgccaaaatttcgctttaatagcaggtgttggcgtggtggtcgtagtttgcagccaagctggaatatcagtgttgggacgtgtcggtttcatgttgaagacctcgaatcaaaagtaagaaaatcaaaacagcggtaatggccgataaaatataacccacactgaccggtaagcccgcgatggcgtaatcactgaacagggcctgaaaatggaacccgtggaccattccttgaggcgcgtgagtactgatatgttgttgcgctagccgttgctgtaattcttgggggctccattcgccccaagccgtattgctagccaacaagcctaatggtgataacaccgctaatccgagtagcagtgcgatccacggccgctgattgcgccgagtgggtgtctgatagaggttagtcggtgcgactcgttttacaaattgaaagacaagcagtgtgaagacgacttcgacccagccggcgactaataagtgagccgtcaacattgcgggtatcgtaatgttgaggccgtatgggcagtagagcggcgcaccacttgccgtatgagccagtatgggttgtaacccgagctcgataccagcaactagcgccgccatattaatgcctaagtaagcaccaattgcgagccccaacttttcatggtgccatttttgacctaggcgatagcaggcgtagccgacaaacggcataatgaccgccatattcaacgcgttagcaccaaaggctaggataccgccatcaccgaataataaggcttgtagtagtaacgtcacggtcagcgcaagacacgccgcccatgggccaatcaagacagctaacagggttcccccgacagcgtgagccgtggtcccacctggaatcggcaagttgaacatcataattaaaaaagccaatgaagcggcgatgccgagcattggcagggtttcatgatgttttttgatttgaactttaacttttaaaacggcgacggtccagacggaagccatcgcggtgaccaacgttacgcaagttgcgggacttaaataattatccggaatatgcacggatgagcacctcactaatttgcaatttgatctaagaggtaactaacatcttgaataataaatttgtgatttttgaccgtaatgacgccgtctgttcgtaattccttgagcatccggttgacactgctccgggagctaataccacagaaaccggcaatgtcgtcattggtgaccacaaagtcaatcagaatcccttcgttaacttttcgtccgaacaaatcaacaagactatagataaaggcacaaatggctccttttttaccgttcatgaccatccgttgcagtcgaagaatgttttcggacaactttttacggtaataatttttaacgtagttttgcagttcaggcgtactgttgacgtacttccaaaaagcgacccggttgacctggtaaaaagtggcgtattcggactcaatacggacgttaaacggttggtccgtagaacgagaaacttcatcacgcagcagggagatcacgtcgggcttggcaatataagataaattatattcgcgaccgtcttgtaaaataatgctgtttttgatgatgccgtcctttaagacgtacgtatagtgttcggctaaaccatgataggtcaggtaagtatgccgcttttttttgattgtcggcacgtgatgggcttccaaataacttagtaaatattcaatatcagttaataccatcttagtttttcagttctttcgtgaataatttttaaggttgaggtcagtaaaaatagcgattctcaacagtaatcacgacgataacgctacttaagcatagcggttttcatgattgtgacaatcgcatttaaagtatacatttgttaactatttttgaaaacttaaaatgtaacggacaagttatccgtcttctagtataacaaaacgtgcatgtaaaaattagtttttagagaaagaggatggctaaaagtcatggttgcaattgatttaccatatgacaagcgcacaattacggctcagattgatgatgaaaattacgccggtaagttagtgtcgcaagctgcaacatatcataacaaattatcagaacaggaaacggtcgagaagtcgctggataatccaatcggctccgataagctggaggaacttgctcgtgggaagcacaatattgtgattattagttccgatcacacgcgcccagttccttcacatattatcaccccgatcctattgcggcggttacggtcagtggcgcccgatgcacggattcggatcctcgtagctactggtttccatcggccatcaacccacgaagaattggtgaataagtatggtgaagacatcgtcaataacgaagaaatcgtgatgcatgtctcaaccgatgacagtagtatggtcaagattggccaattaccatctggcggcgattgcattattaataaagtcgctgctgaagcagatttgctaatctctgaaggctttatcgaatcacatttctttgctggtttttcaggtggtcggaagtccgttttacctgggattgcttcatacaagacgattatggcgaaccattccggcgaatttattaactcaccgaaggcccggaccggtaatttaatgcataatccgattcataaggatatggtgtacgctgctcggaccgctaaacttgcctttattatcaatgttgttttagacgaagataaaaaaatcattgggtcatttgccggtgatatggaagccgcccataaagtgggctgtgactttgtcaaagaactttctagtgtaccagccattgattgtgacattgcgatttcgacgaatggtggttatccgcttgatcaaaatatttatcaggccgttaaaggaatgaccgctgctgaagcaacaaacaaagaaggcggcacgattattatggttgccggtgctcgtgatggtcacggtggtgaagggttttatcacaacttagctgacgttgatgatcctaaggaattcctggaccaagcaatcaacacgccacggcttaaaactattcctgaccaatggacggcccaaatctttgctcgaatcttagttcatcatcacgtgatttttgtgtcagacctcgttgatcctgatttgattacgaatatgcatatggaactagccaagacgttagatgaagccatggaaaaggcctacgcacgcgagggtcaagccgctaaagtgacggttattcctgatggtttaggcgttattgtgaagtagtatggcaaccacagcagaaatattgcaacaagtggcggcagggcaattaagtccgacggtggctgcccaacagttagaagcaggcaaaacagcggcattaggttttgccaatgtcgatttagatcgtcaacgccgcaatggctttcctgaggtcatctacggtgctggtaagacggcaacccaaattgtgggtatcgtgcaagccttgtcccaacagacgttaccgattttaacgacccggttatccgcagaaaaattcgcggcactccaaccagcgttaccaacggctgtctatcatgccactgcgcagtgtatgacggtcggggaacaacccgcaccgaaaacaccagggtacattgccgtggtgacggcggggacctccgatcaaccggttgctgaagaagcagcagtaaccgcggaaacttttggcaatcgtgttgaacgagtctatgacgtgggtgttgcgggaatccaccgactgtttgccaagttggatgtgattcgtggtgcccgggtggtcattgtgattgcgggcatggaaggtgcgctggccagtgtcgttggtggactagttgataagcccgtgattgcagtgccgaccagcgttggttatggtactagttttcaaggtatgaccgcgctattgaccatgctcaatagctgtgcgtcggggattaccgttgtcaacattgataacggctttggtgccgcttactcagctagtatgatcaatcaaatgtaagattcagttaactgaacaaggagaagataaatgcaaacactttatttagatgctttttcggggattagcggtgatatgtttctgggcgcgttactcgatttaggacttgattttgagcagttaaaaaccgaattggctaagttacacgtgcacggttatgaattaacgcagcaacgggaagcccagagtagcatctatggcacgagctttgatgttcaggttgcgggtggtaaggaccatggttttgtggaacatcaccatcatcagcatgaagctgggcatcatcatgatcatgaagcgcgtcatttagctgatattgaggcgttaattgacggcagtgacttatcagataccgtgaaacaccacgcgaaagcgatctttatggaaattgcgcaagcggaagcagcggttcatcacatgccactagctgaagttcatttccatgaagtgggcgcgttggattcgattgttgatattgtgggctgctgtattgggttggaattgatgcagattgataccatcatggcttcaccgttaagtgatggtagtggttttattaacgttgcccatggtcagatgccagttcccgtaccagccgtgatgcagatgcgagttggtagtgccattccgattcaacaacggttggatgtgcatactgaattgattacccccactgggatgggcttggtcaagacgctcgtacgtgaattcggaccgttaccggaaaatgccgtgccaactagagttggttatgggtttggtaaacgggacacgggtggtttcaatgcactgcgagccgtattattcgaaaaaaaaaactaagtcagcaaatcgttaaccggacggctgatgctgtcttaatgattgaagctaatctggatgatcagacgggtgaaggactggggtacgtgatgaaccagttattaacggcgggcgcatacgatgtgtttttcacgcccattcagatgaagaaagatcggccggcgacaaagttaacggttttgggaaacgttaacgataaggacttactgactaagttgattttacaagaaacgacgacgattggtgtacgttaccagacgtggcaacgtactattatgcaacggcacttcctgacggtcgcaacgccgtacggtgacgttcaagttaaagtggcgacatatcaagatattgagaagaagatgccggaatatgcggattgtgcccagctggcgcagcaatttcatattccgtttagaacggtctaccaggcagccttagtggcggtagatcaattagatgaggaggcgtaattttttggtacatcagttgattgctgaatttatgggcacagccctaatgattatttttggggtgggtgttcattgtagttccgtattaaagggaaccaagtatcggggttccggtcatatttttgccattacaacttggggttttgggattagcgttgccttattcatttttggcaatgtttgcattaacccggcaatggttttggcgcagtgtctattaggaaacatcgcatggtccttatttattccgtattccgttgcggaagtgcttggtggggtcgtgggctcagtgatcgtttggatcatgtatgctgatcattttaaagcctcaacagatgagatttcacccattacaattcggaacttattctgtacggcaccagccgttcgtaacttaccacggaatttctttgtggaattatttgatacatttatttttatttcgggtattttagcgatttctgagattaaaacgccgggaatcgtgccaattggcgttggcctacttgtatgggccattgggatgggacttggtggtccaaccgggttcgcaatgaacttagctcgagatatggggccccggattgcacacgccatcttaccaattgccaataaagccgatagtgattggcaatacggtatcattgtgccaggaattgcgccctttgtcggggcagcaattgccgcttggtttatgcatggcttttttggaattaattaaattaaatagaagaagggttttattatggcaacattggcaacaaaaaaagcaacgttagtagcagcattaaaggatttacaacgggtcaccgtggccttttctggtgggatcgacagtaccttagttttgaagatggccctcgatgttttaggccgtgacaatgtgaccgctgtggttgcgaactctgaattatttacggatgaagaattcgataaagcgatgagtttagctgaagaactaggtgctaacgttcaaggaactacgctagactacttgagtgatgaccacatcaagaacaacacacctgatagctggtactatgcgaagaagatgttctacagccggttgaatgacattgcggctaataatggtagtgcagctgtcttagacggtatgatcaagaatgatgaaaatgattatcgtcctggtttgaaggcccgtagtgaagcgggagctcggagcttgttacaagaagctgatttctttaagactgacgttcgggccttggcacaagaacttggtttgacgaactggaacaaagtggcgtcatgctctgtatcttcacggttcccatacgggacgacgttgacacatgacaatattgctcaagtgatggccgccgaaaaatatttgcgtagtttaggttttccaacggtccgggttcgtttccacaatgatattgcgcggatcgaattaccagaagcacgaattggtgatttcttagtctttaacgaccgcgttaaccgtcaattacaatcacttggattccgctacgttacccttgatttaggtggcttccgtagtggtcggatgaatgatacgttgaccaaggcacaattggccactttcgcctaggcctaatcaaattaatgatagtggtgtcgggattaatcggagatgggcggctgaacggcggtgatcatggttcattcgcccacccgatgataatcgtaaccccagccgatacgcacatgttgcgattatcgcctgacaccccaaaaagcgcagttcaaggccgcccttgagctgcgtttttcgtatcttcatttttagatcaacaggcgtcaaaagtcacgacgagtttaccaacgacttgaccagcttggagttgttgtaaaccagttacaagttggtcacggtgcaagacctgagtaattagtgggtcgaccttgccagcttggaccaaagctaataaggcggcggtcatttgcccaagatcagcaacttgcgctgggttaccgctacggtgggcaccaccgaggtccaatttactgatagttaccacttgattacttggaaagtggtccggagttgctaatacacagacaagctggccattgtaagctaagcgcggtaagtccgcatcagcatgaccaatggtattaatgatcagatcaacaccgtgctgctgcgttaggtcttgaatgcgtgtggtcacatcttcatgatggtaatcgatttgggcatcgggatgcagcggtgccacgaaggcttgcttggcctttgaaacggtcgtgaagacggtcttgccagcagccttagcgagttgaatagccatactgcctacaccgcccgcacctgcatggatcagcacagtttgcgcggcatttaaattggctttgcgcaggagggcctgataagccgtcaatccagcgcagagactagcggcggctgcttcaaagctcacagtcgttggaatcttagctagcacggctgctggtaaactcacgtattcggcaaacgtcccattattggcgagattagcgtgcccacaaactcgttcgccaggccgaaaattagtgacctcagcgccaaccgcctccacgattccagctgtgtctagtcctagtgtgtgtggatattgccaggcggcgttacccgccgcaactaatttaaaatctaccggattgagcccgactgcttgggtcttgatcaacacctcagttggcccgaggttgggcatgggccgttcttgccattgaagctgttccatagtttgagcggatggatctggcacaacaagtgcttgcatcttcaatcactcttttcttaaaggcatatttgctttttattataaccggtcgcggcggtgaatttaaactttaatgcctaattaattaagtagcaatgagggtgattcggctaacggaaagattgacgttagcggttacaatcgttagactaaggttagtaattgaatatttttaaacactaggggtgtccaaaaatgggctgagatggtgctgtaagtaccgatccctttgaacctgtaagctcaaacttgcgtaggaaagtgtcacagctaatgttagcggccactggatcaatgcatgttgattggtggccgtttttaattggcgtgacggtcaatgaggaggagaattgctatggaattacaattattgaatactttacgggatcacaatccgattgtttttaacattgccaattttgttacggttcaagacgttgccaatgggctaaacgcgttaggggcctcgccaattatgtcagctgaagtccaagaagcggagacgatggtccaaattgccggggcagtttgcattaatttaggaaccctgaccaccacccagattgatcaaatgcgggtggttggtaagcttgctaatcagtatcataagccagtcgttcttgatccggtggccgtcggggcggtcccttatcgtaaagaagtcgcgctaggcttactatctgattttcaagtcgatgttattcggggcaatgctggtgaaattgcggcattggcaggcatggattggcaagcgaagggcattgatgcgggaagcggtcagggcgacctggttgaaattgctcaagcttgtgcacagcaattccaatgctgtgtcatattgtcggggcctactgatgttattacggatggtcagcgcgtagttaaagtcgctaatggtaccccgctcttccaacgtcacgtgggctcgggcgatttactttctagtatcgtcgcggcttttacagccgttagttcaaccgatgtttaccaggcggcgcaagtggcttgcttagtcttagcgggagcgggggaacttgtcgccagtcagctgacggccgatcgtcccgccacatttgccattgatttgattgaccggttgagcttagtgacagtgtcagaaattcaaacaattgctaaagttgattaaatataatgaagggtcgcgagatttaatgaatgaatttccacaagtggcaacgattgctggtacggacagtggtggcggtgccggtgtcatggccgatttaaaaacgatgcaggcacgtcacgtttttggtaccgcggtagtcgttgccgtgacagctcaaaatacattgggggtccaagattttatggcaatgccaacgaagctcattgacgaacaatttgtttcgttagcagctgacttagacattcgcgcttgtaaaacggggatgcttgcggatgctgaacatgtccatgccgtcgttgagaacttgaaacgagttgattttgggccgctgacagttgatccagtcatgattgcgaaaggcggggcggcgttattagccgcggatgcgattaaaacggttcgcgacgaactgctcccgttagcgactgttgtgacgccgaatttgccggaagcggaacgattaaccggtcaggcaatcactagtaatcaagcgatggttacagctggacatgcgctacaggggttaggcgctgacaatgtcattattaaaggtggtcatggtgataatcctgatttagctaatgacttcgtattgttggctgacgggaccgccttttggctttcggctccacggattgatacggtgcggacccacggcacgggagatactctatcggcatgtattaccgccgaattagccaaaggacggtcaatggatgcggccattaaaacggctaaggcgtacgttgctgggacgattcaggatggtatccaggtcgggcatggtcatggcccgttgaatcattgggcaaccccaagtgagcaggtgatcgttcatgacgcttaaatttgaacccacacaattacgtgcttattttgtgtgcgggacacaagacgtgccgggacaggatctaaatatggtcgtccaaacggccttggatgcaggcatcacggcatttcaataccgagataaaggcaatagccagttgactacggctgagcgttttgcattggggcagcagctgcgggaacgctgtgcgcaagcgcacgttccctttatcgtcgatgatgatgtcgagctggcactcgcactgcaagcagatggggtccacgttggtcaaaaggacgaccgggtgacacaagttattcaacgggtcgctaatcaaatgtttgtcggtttgtcttgttcaaccttagctgaagtgcagattgctaaccaattggaaggcattgcctatcttggtagtggtcccatctttccaacgacatctaaggccgatgcggatccagtagtcggtctgacggggttgcgacaattagtcatgactgcatcctgtcccgttgtcgccattggcggaattacagtcgcgcaattgccagctattgcggctactggtgcggctggtgctgcggtgatctcaatgttaacgcgtagtcccgatatggctgccacggtcaaggcgatgctaacggctacggaggtgcactgatgaaacatgacgggatttttcggagccaatttttactgtggctcggtgcggctatctcaattgccgaaatcttaacaggtacgctgatggcaccactggggctgacacgcggattggctgcgattgtattggggcacttgatcggctgtggcctgttcttggttccggccggctatttgggggctaaattacaccagtccgcgttagcgtcagcccaactggcttttggtcgcggcggagtgttactagcgtcaggactcaacgccttgcaactcgttggctggacggcggtgatgatcgtcaatgctcagttagccatgaacagtattagtggaaagctatttggctttcgaagcccgctactaatggcaaccatcgtggcgattttgattattgcctggttgctcatgggtagtcagttactgttcaaaatcaacaatgccgttgtgggcttgttggtgctcgggacggtgttaatgctcgtcatggtatttatggcaccgacaactagtcagtcgatatcaacgactagtatgacgtttgggcaagcagtggaattgaacgttacgatggcactctcatggttgccactaattggtgattatacccagcgtgttgatcgtcctttaccagtcgcactagtcagcgcgggtggctatatgttaggcagcttagtgatgtttgtgacggggctattagttgtgttacggacagggcaaactgatatcacggcattgctgacgcggtccggtttaggattggttgcattgctgattatcgttttttcaacggtgacgacgacatttttagatacttattcggccgccacgagtttggctaatctgaccggtagccgccatgttaatcgattagccattggtgtgacggtagttgggctattgattgcgctgacggttgccatgacgtattatcagaacttcctgtatttgattggttcggtcttcacaccgctatatgctattattttcgtcacgtactttgtgcggcacgctacgttaccatactggttgaacttttgctggtgggttgtggggattgtcgcctattatcagttacaggccattgatttcattggtggcacgacgctattagtattggttgggctgagcatcgccgtctggttgacgggaattgtcgtcaagccaaccgagctcggatatcgcgagcttagtcattgacaattagatgtaaaaagtaaatgataatcccattggtaatatgcatgttaccgtgggatttttttgagagagggcgacagaatggttaaaccgataattggaatcgcaccaggcgttgtgacagtgaacagccagatgttcccggggcgggtccgtgattatgtgaatcgtgattatttgaaatcagtaacggataatggcggtgtgccattggtattaccggtaacgaccgacgcaacgacgattgaacggtacgttggaatgatcgatggtctactactttgtggtggtgcagatgtggccccattgacgtatggggaggaaccccagcctaaattgggtggggtagatccggaacgggatcagtatgaaattgcactgattcgtgccacccacgccgttggtaaaccggttctcggtatctgtcggggcttacaaatcttaaacgtgtgctatggtggcaatctttatcaggatatgagtgaactaccagctggtcagggtaccttaaagcacatgcaaggacaattggctgcttacggcatgcatcacgtgaaggtcgtacctggtacgaccttagctgaatatttaggcaccactagtgacgcaatcgcggtcaattcatttcatcatcaggccgtgaaacaggtggcaacgggctttcaggtggtggcccaaagtgcggatcaggttgttgaagcaattgaggcgacagctggtggtctacagttgggtgtccagtggcatccggaaatgatgcaacaggtaaactccatgcaggcgcggttatttgcagcgtttgtgctggcttgtgtggcgtagatagcattgactagcaaattgataaaatagggcgtggttattctgaattgtaggataaccacgtttttaatgtgcagccgcaaaactaatgaatgtttcacgtgaaacatctgaaatggtgttggcaactagataactaatccaagatattgtaagctgacgtgtaaaacaattcgtaaagctgttaatactggcaacgctttcgtataatggaataaagttattgttaagggggtgaccgttatggaacgaattgaagctggcatgagcgtaatgacgttgaagaagcagacctatcgggttatcgctgtgattaatcaggggcaagaactgttagttcgcgcccacgaaccagaaacagctgacattgaaataattccagtgaccacagttgttcgagtaactgaacaaaattcaacaggcgatgcagccgtcgcattggatacagtcacggtcgttggcgaacggtatgtcgatgatattgtggcaacgttaacgacgctcagagtgggtatggcggtgttgctccagcgagaaagtggcaatcaatacgatgataatgccatctcagtgtggacgttgcaacatgctaagttaggctacattgcccggtatcagaatcagccgtacgcggcactgatggatcagggacaacgattgtacggcatcgtgacggtattagatcaacaaaaacagcatcttgaattgatgctatggcggactactgcagtcccaagtccgattgaggcgttgcaaatccgccaacgattggctaagccgaggacaaatttaggggcggtgccaacgcattcgttacagacaccgttaggaacaattgtcatgatgtgcaatggtcacccgattaagtatcagcaggttccgttatcgccatggttgacgcccgctgatgaattacacgtcaccaaacgttatctattaacgcctgattggtcacaagtgccgccggacagcctcattacttgtcaagtgacggcgaaggccgacgtggttcagcggtggcaaaatgaacacatttcagcagcggccttaacgaacgctagtagcttttatgtagttggtatcagtgctcaaatcaagacggggctgaatgataacttggtcgatgatgctgcgcaacccgcggttatttaccgagttggccaggttagtgcacatatgcaggccggcttcatggtcagctgggcgccgtttggtgatccacgcgtgcaaccagcactgaaattagcattgcacttctcctcacaaccgctagttccttaccatccagtaacacctagtcgcaccaacgcgacgtttacgcagcaagagttggcagccttgttagtctccgcattaccaaattatcagggtggtcaacgcttagaaccaagtgtgacagcgataacggtagaaaaattgcggcagacgttaggtgatcagacgtatcatgcgctggcgaattatcagcgtcatgttcagctagttgcgggtagtacggaaggcgtcaacgagaccttgttacaggcgttgattcatgcagtcacgtatcatgagttgacgaccatgcactactaccagccgactgtagggatggtcgaccaggttatttatccgattcaattatttagcaccacgactaaggatgaggatgatgtgcaattagtgggttgcttagcgctttacaattacgaaacgtttgaaatccaacaggtgccgctgacggcaattgctcgtatcgcgattattgccgatccggagcatccccagacaacaccggagacggaaagtccggattggttacgcatatttttacatgggtggaatgacgatttttgaacgaacagtcaaaaattaatttgcttacgacttataagtattcgtgatacaagccagattgaattcgataaaaaatcccgctgaggctttaaactcagtgggatttttggttaggttatttggttgccgaatgggtctgtaaatattcctgggcggcgtgaatcatatctgcattttgttgatttaacaatggcggcaagttgtcgaagtcaaagtagtcgagtttgagtgtttcatcagtggcttgggtcagaacgtggccgccaatgggttctacaagaaagagtgcactgattgtttgagctacatcgccattaggataggccgtctcgcctttatcaaagatgccgatgcgatcaacaacttcgacatcaatgccactatcttccttatattcccgcacgcaggccgtggcatacgtctcaccgtattctagatagccaccgggtaaactccagttatgcgtatcggtacgaaggttcagcaagacttgttgctgatcgttgactaaaataccagcggccgtattcaaaatgattggtttgtgaccaaccaaagcccgaatttctttaatgtaatttgccatgacgaaacctcgtttctagtttaattacccttattataccgataattctgactgaaagctgtttgttgataaatttatacgaagcatgctcgaaccgcgttagagcaagtgcatactgactatgtgtcactaaatccgtttgcgtcggtgcacttttttagctaagataaaagctatatactgtcagccgtgatagtgtgagttctttgattttatgaaaagagagtaatttatgcagagaaaattaagtacgggccagatgcaaatgattgcactgggcggcacgatcggagtgggcctatttatgggatccagctcaacgatcaagtggaccgggccgtcagtgctaattgcgtacatcgtatcaggggcctttctatacctgattatgcgggcactaggtgagatgctgtatgtcgatccgaataccggttcgtttgccaagtttgcttctgaatatattcatcccgtttttggatacttgacggcttggagcaacatttttcagttcgtcgttgttgggatgagtgaaatgattgcattaggcggctactgccggtattggtggccgaacttgccagattggattccgggcctaattgccattgtattcttatgtgcggccaaccttatctcggttaaaatgtttgggacgctggaaacctggttctcacttattaaagtggtgacgattattctgatgattattgccggtttaggtctgattatttttggtattggtaacggcggtcatccaattggaatcagtaacctgtggacccatggtggtttcttcactggtggggtgaagggctttgtcttcgcactagcaattgtgttggcgtcgtatcaagggattgaattgattggagtcacagctggtgaagctgaaaatccacaaagcacgatcgttaaagcgattcgttcaacggttgcccggattttaatcttttacgtgggtgccatcttcgtaattgtcagcatttactcctgggataagttaagccagatcggttcaccgtttgtacagacatttgccaaaattgggataaccgctgcggcttcgattatcaacttcgtggttattacggcctccttatcgggaacaaattctggaatttatagtgcgagccgaatgacttacacgttggcggaaagtcaccagttaccaaggaagatgactttattaaatcgtcatggcgtaccattttattccgttattgcgattgcgaccggaattctaattggagtcgtcttgaatgttgtgttaccaatgtttttcaaggacgctggcgagattttcgtgatggtttacagttcgagtgtcttgcccggcatggtaccgtggtttgttattctagtgagtcaaattgcgttccgtaagcaaaacgcagccaagatggcgaaccatccttttaaaatgccattatcaccctattcaaattatttaacgttggccttcctcgcgttaacactggtcttcatgtttattaatccggaaacgcgctactcaattttagtcggtgttgtatttctagtcatcatgacattgatttatttccgtaaatacgccggtaacaaggaagaaacgttgtaatcaagagtacttgccagtaaatggtaagtgcttttattttgggcttttattgcgttaaaattaggtatcaatatcaatatcaatatcaatatcaatatcaatataattatcaggaaaagtggtggcacgatggtcaagcaaggacattatgcaaaagtcagtaaacagaaacggttacgacaattaaagcaacgacgtcaggcccaggagaagcgggcgattatgccagaaatggttagcgaatttttgcaagtgcgttaccacctgacgcaagcggcaaaacagcggccggcgatgcgacagatgatgcaacgttttatggcacagtggttagccgcagggcaagcagaattgagcgacaatggtcagacaacgtggtcagtagtggcattgacgaagcaaacgttacagacctttaatcggcagttaccgtggcaggggtatgccttagttgaccaggaaatggcacgctggacggcttttctgaacaaggaagtgccggctgtgccgttaagtgagcggattacgttaactgaggcactgtccccagcgacgtggcaggcctgcctatcagagcaattagcaatcaatgccctattagcattaactggtgattcacgacaattgggccaaataacgactgagcaagtacgacagctacaaaccagtattcaaacagcgacggggattgattgggaaaaggttgctcagttgcttgattcgacagtgattgcccagaatacactttccgaagctgggctggatgacaaaacgcgccaatggctagaaaaattaaagaagctaacgccacaagattttaacgaccatgttgaatgaatagtcaaaaaggaggatggtgaaatgcgttttatcacgtcagatcacgttcagttagattatacggatgaaggccaggggcagccaatcgttattttgacgggatttggtggcgctaaggatatttggcgcgctcaaatcccggtactgattcaggcgggctaccgggtcattaatttagatgggcggtgccaaggtttatccgagcacacggcgaaaggcttacgtatgagtcgtcgcgcggtggatgcgcatgaattgattgaaaaattacaactcgaacaaccaattttactcggtaattcgatgggggccgcgacttggtttgcgtacgtgtcattgtatggtgatacaggaattaaggccctgatcgacgtggatcaaacgccgcggatgatcaatacaccgcactggcaatatgggttcaaacaggttcaatggcaggatattccggactattttagaatgccgctgggacactcgacgtttaagcacatcgatgatgcgacgtatgcgcgcgtcaaggcagtagaagcgcaggcaccgttcgatgcgaaattaatgtttccattgttggttaaccacgcggttcaggattggcgggatgtgatccgccaattgaccgtaccgttcttgatcattgcgggcgccaagtcaccgttcttcaatcccgactttgcggcagtgactgctcaaatggcactacgaggacagagtgtggtcattccggaagctggtcatatcgtgatggcggaacagtcggcagcatttaataaggcgttgttggaatttttggcgacgtgctaaacgaaaagcacttttaacacctgtattaaaggtgatattacagtcttgaatagtagtcatatcaagcaggtttagaataaaataatgtattatgttgtcttgaataacggccacatcaaaaacagtttcacaatactaaaaaaggctcaccaactaaaacaggttggtgagccttttcgatttattgactaattactaatcaatcacgccatcttttcccatccatcggaaccgaataaacttcccgacctcggtcacaatcaagacgacgatcccacagataatcgggatgccccaaccataccagaagttgatgctagtcgtatggaagacggattgcatgaatggtaggtaaatgattcccagttgtaagagaatcagaataccaatgatgtagaacgccatcttattttggaagaagtacttggaaataacggggtggtcattccgcaagttgaagaggtagaaaatcttaccaaagatgatgatgttcagtgacatggtactaccgacgacgtttggtaacccaagcgcggtcaagtagtcgtaggcgaagatccccaatccagaaattaggaaggagacgtagccgatttcaaagtaatctaattttgacaacaacccagacttaacattccggggaccccgcgccatgatgccagcttcgggtggctcaaagatgaacgcaaactggatggtcagcgcagacaccatgttgatccatagtaattgcgtcgggtacagcggaagttcgtggcccattaaaatactaatgatgacaacgaggccttccgcgaaactagttgggagtaagaagcgaatcgtcttacgaatgttatcgaagacgtggcgcccttcacgaacggcggcgacgatatcagcaaagtcatcatcggccaggaccatatcggcggattccttagcaacttcggtccccttgattcccatagcaaccccaatatcggcttgcttgagggccggggcgtcattgaccccatcaccagtcatcgaaacgacgtgattattggcctgttgggcacgaacaatccgtaatttgttattcggtgttgcccgtgcgaagacgttataatcgtcgatgtgtgcttgtaactgctgatcatccatcgcgtcgatttcaggaccagtaattgctttgacattggcggccaagttcaacttgttggcaattgccatcgccgtatcagggtggtcccccgtaatcattttaacttgcacgcccgcttgccgtaattcggcgatcgcggtagccgcttcttcacgaggcgggtcaatgattccgactaagccagctaaatgcagcccaccaatggcttgtgcatcaatggtagtcacgtcatcatcgacttcttggtaagccagcgccaccacgcgcaaaccatcggcggttaagtcgtccatggcgtcatcccagtatgccgtttggttagcttggtcagttaaacgcaggacagtcgcgggtgagcccttgaccattagtaagcgttgaccatctaagtcggccaggcgagcagaaaaacggaaggcggaatcgaatggtagcgagtcaacttcttcaacctcaggatcatgaccagtcattttacgatacagcgtcgtcaaggcaccatcggttggttcaccggtcagttcccagcgattgttttcgaagtgtagctcggcgtcggtcgtttggccggcaatcttaacgagccattccatcgcgttatcttggtgccagtcgactttgttgccattgagcttgagatggccatcgaagttaacgccaccattatcatcataaccgacccccgtcacatcaaacgtatgctcaggcgtcacgaccttagtgaccgtcatttcatttttcgtcaacgtcccagtcttatcggtgttaacgatatctacggcacctaaagtttccacggcgggtagtgacttgacaatgacatttttcttcgtcatctgccgggttcccatggctaagaccaccgaggtactagcgggcagtccttctggcatagaaccaacgaccatcgtaataaccgcaattagtaaagttggcaaactataggtatccatgaccattcctaataggaataataggacggccgccaccacgatggcgatggataagccgacccccagtgagttcagattacgcatcagtggggtagtggtttgtttgacgtcactaacagactgctggatatgaccgatttcggtatcttcggcggtagccgttacgattccgacggccgaaccgctagtcaccgcggttgacgcgtaaaccatattcttacggtcagccaaagccggcgtggtctctgtcatcggttcttcttgtttctccacgggattagtctcccctgtcagcacggattcttggacgttaaagttgtccgctgaaatcaagcgcatatcggcaggaaccgcatcaccggcttctaagttgactaagtcaccaacgactaattcgcgggcgtcaatttccagtttttttccatcacggatgacgaaattctttgaaatcagcatttcacgaatccgttctagcgcgttgccagcttggcgttcttggacataaccaatgatggcattggcaataataaccagtccaataacgatagaatcggaatagtggtgcatgaagaacgttaagaccgctgctgcggctaaaatgtagataatactgttattaaactgcttgatgaattggacgaaccgagacgtacgcttggtctccagttcgttgcgaccgttatgttgtaaacgctcggcagcttcagcagtgctcaatccattctcaggatcggtggcgtactttgcggctaaggctgattcatcaagctgccataagttatccgcatcgggagggttctgggtgtcgttttgctcttcagtagaagttaacgactgattgtcatcttttatcattcaattcgctccttaaaaataaagttattaccggtgaggttctgtaaaatcacgacgtttattgcgtgttaagtaggccaatttcgccacatcctttcttaattagcgttattataaataatattatatacgaacaatctaggtgaatgccattaaaatatttgacaaattcatgacaaattattgcgttagttgcaataatatatcagattttggctagcttgtcgctgaaaatgactggttttcctcgaattgttgggtaaattaaactagagcactatgatccgcgacattggggtgcgggcggtgttcttgctgccattgaactagctgcggaaagtttggccgcatattagcgaataaaaaacgagcagtcgataactgttcgttaatagtggctaatccttgatggggtccttcattaataaccagagaatcaggtaagcgatgataccagggaacatgggtgtaattgctaaaacaacaaataatagccgggtaacgtcagtattccagttaaaatgttcggcaattccaccaatgacaccggcaatcacccggtccgttgcggaacgatgaatatcgatcttcataagttaattcccccttaataatgctaactataatgtagcaggtttgattcaataacgctactaatttaatcggttggaaatggtgtagtggtaagaaccgtggtatagtaggtgatttcgctcaaagcttggtgaagtgcatgatcgtagcgtttgctcaggggcgcgttagcgataaagtgaccgttactttgaagggtttgtggtacgttaccaatgggcgttggtttagggaggacgaccattcctaatcgttggagaactggaactagtgcggccgctccaaattgaccgccgcgcatattgtcagaatatgagataatcttagccggtttacgggcgccttcgaatgccaaaaaatcgaaggcgtttttcaatccagctggcatcgcgtgattgtactcgggtgtcaggataatgtaaccgtccgcactagccatatcggtgagccattgctgctggttagcaggtagctcgcggtgcgggttcgccatcggtggctcgggttcatcgaaaaagggaagttgatagttggccaaatctaaaaattggtagtgaatcggagaatgagtcggtaattggtcaatgattaattttaaatgattaaataaagcgcggccgttagcctgtgaccgggtactccctaagatgattgcaattttaaacatagtgggacctccagatatttttattgattctaatgaatacaaaatgatagtatagacttaataatattggtatgcaagtatttattcacttgaattaaaaaggagctatttaaatgacaacaccattagttagtcagttgatgacggaactaaatcaatttttgacgcaggatagcgttgatgatcaagaaaaacgctgggccatgcaacaaacgactgatccgcaattacaagcggcattaaaacaactatcgacgacggatattaaaattatggcgtatctgggacagcacgggccaagtcgagctaagacactgccggtaccaacgggtctctcacaagcaacgatttctcgtggcttgaccaaattagcccggttagaattggcgactaagtatcgtgatttgaccaataataaagaagttctcgtacgattgacggcgctgggtgaagcgggtgccgagctgcatactcagttggatgcggcgattgcagccaaggcacaagcgattgccgatgactactctgacgcggaactgacacgctttgttagcctcatgcgccggattcgtgaaattaagctttagcacttgatgttaccgagtgctaaattgttgcattcccacaaaatggtgttagtatatatatcgaaggtcaggaaaggtcaaacgaagatttgaattactgaccagtattaatagccaagtgaaattttgaaaggggattgttagtatggctaatactttaatgaatcggaacgatttcggcatgttggatccgtttgaacggatggcacgctccttctgggcaccattagaaaacatggatcaagtattgaagaccgacattaacgaaactgatgatcagtatcaagtgaaggttgatgtccctggtattgataagcaggatgtgaagttggattatcgtgacaatgtgttgtctatcaaggttcaaaaagatagctttgtggatcatgaagatcaagaccaaaacattctgatgaatgagcgtcatactggcaccttgcaacggcagtatatgttaccaaacgttgcggcggataaaattacggcatcccaagctgacggtgtcttaacgattacgttacctaagacccagccgagcgcgaatgacggtcaaatcgaaattcaataattaaatcatcagtaacaagtgagcggcccaccgataatcaaatcggtgggccgcttttgacatcaacaatcggtatgaattatgaccggtggttggtaagctgttggtttagctggatgactttgatgtgggcgtgtgccatttcgattaaccatagaccgatataggctccggtgtatatcaaggtaaagaagccaaaccagcgaacgtttaatggaaaccagccacagagaatcgcaagtggggtcatccctaggtaagcaccagtggttgtttcacaataaagtcgtttattggcagtgtgaaaacgtgacaccgattgaagtggcagcttaatgagcaagcgattttgataatcttattgtagtgaaaaatgcggcttgacactagtgcttattgctacttggtcaactaaacgggctaactggtcaggaaatatgacaaaaaatttcccgggaaataattgtcactggtggtcgctaaatatgataagctaattaacggtataatacttactgaaaattagtgtcagttagatatggagatgacgagcgtggatgacgcagaacgtgaacgcggaccatggcatcgtaatttgattgttttatggttttgtacgttcgttgcgggaatggcatttagcgaaattatgccatttctttcattatttgttagtcagttgggtgatttcacgaaggcccagattacattttatagcggattagcttttgcagctgattacgcgatttcagcaatttcggcaccactgtggggcatcattgctgataaaaaaggtcgtaagatcatgctattgcgcgcgtctctagggatggcagttgcgatggggttaatgggctttgtaacgaatgtctggcaactagttgccttgcgcgcgttacaaggtgtgtttgcgggctttatttctaatgcccaagccttagttgcgtcccaaacgccgcgtaaatatagtggacgggcgttgagcactttgatcactggtgccgttagtggtcaattgtttggcccagtaattgggggcttgctagcccaattgttttcgattcgaaacacgttttttattacggccggattattaatggtggcgtttttgttgagtctgttctttgtacaggaacacttcaaaccagtcgcacatcatcgtgaaccaggtgacagtcgcaatcctttagcagcgtttcaaaatccgcgcttgattattgtgatgttatgttcgacggccatcgtccaatttggaaacgcctcgattgcaccaatcattagtttatacgtgcgtgaattaatgcattaccgtggctcgattacggttgtggccggaattatcgcagctttaccgggtatttcaaacatcttttcagcaccgcgccttggacgttatggtgatcagcacggttctggtaaggtattgttatttggctatatttttgcggtgattatgtatttcccacaaggcattgttacgagcgtcgtggccctcggtattttgcggtttgccattgggatttccgatggcgcactatatccagagattcaaacggttttgactaagaatacgccagtacatcttacctcaacgatttttagctataatcaatcttttcaagctattggcaatatgttcggcgccttgctcggtggtttggtggctggttggttcaattacaacgcggtattcattatgacggcgttacttttgttaattaacctaggtttaattttgtggttagttcctgatatttggaagaacggcaaacggacagtttcctaggtgtttggtagttagtctattaaattggctagctgccttttttgttacttgtccttgaacatgatgttaattcggtgtattgttagtttcatgaatatcgaaataagcaaacaagatcaggctgatcagcaacgagtggcgattttcaaagcactggccgatgctaaccgattacggattatccgggtgctctatcaagcacaacgggaaatgacttgcagcgaagtgggggcgcaattaaatatcagcaagtcaaccgtctcttatcactttaaggccttgcggttagtgggtctcaccaatacgcgacgtgaagcacagacgaagtatctatccttacaattagcgacctttgaccggtttttaccggggttcttagcaacgctttagttttttgctttttagttcgacaattatcgaactaaagtcttggaaagaagatgtcaactacttatgaccacaacacatcaacatagccgctatttaacacttggaatgatgttagcggcaacgaatatgcgtttaccaattacaatgatgccgggattaatcagttctttgaaacggacactgggtttgccgagctcgatggcgggattactgaccacgattccattattgacgtttcccattatgtccccattgattgcacattgggggcggcgatttggcaacgaactgacaatttatgtcatgttgatctttctagccgttgggagttatctgcgggtcatcccaacgattgcggcccttttcattgggacgttacttgtcgggattggcgcggacggtggcaacgtcttgattccagcgattattaaagataattttccgacgaagattccagttgcaactagtcaatacacgctctcaatgctattagtcggttcactgggaacaggactttcgggagtgttggcggcacactggtcgttaccactaacgatggcggtgctatcggtgattggactaattaatttggtcgtctggttgccaaacttgaaatacaatcatcgcgcaccaacagttgcgatgaccgcgagtgatgggcagtcaacggcaactcacgggagtgtttggcggcggccgttagcgtgggtcgttacggcctttttcggcttgcaagcactagtctactattcattactgacttggttaccaacggtatttgttgcccacggcttctccttgattgtggctggcaatttagttacggtcatgcaattgagcggcctaccgatgtcatatttagtgccagcgacttctggtcatcggcgcggcgtttgggcaatgattatggtggtaggtgtcggttttattgcgggaattggtggtatcttactttccggaacgaatttttgggtggcagcactgtcctgcgtcttactaggattaggctctggagcagccttcagtttggcagtcgtcttctttacgcaaaaaacgaccaatgggtttgaaacggctgacttatctggtatggcccaatccgcgggctatttgttagctgcagtggggcccgtactattcggctggttaggcggtcaattaggctggggaccagtactctggttagctatcattctttccgcgttactagcattatccggcagcatcattttccagcatgcaacgatttatgagtaattaatatcacaataatgcagaacgagattggcccaagtcaatttcgttctttttttgaaactttatctttgccttagagttactctaagggactacactaatctctattcaattaaggaggccacagtaatatggcggttattcaaattctaacggtcgtcggcgtggcgatcatcggggcaagccttgtaggtgatcctactcagcaacgacagtcaaaaccagtaaaggagcaaaaataagatgacagtgttaacaacgatgtatcaactagcaaatggtgtcaacattcccaaagtcgcattcggaacttggcagatacctggtggtgaggcaacgtatcaagccgttcgtgcggccttagcagcgggataccggcatattgatactgcactggcctatcaaaatgaagcaagcgttggccaggcgattcgtgattctggcattccgcgtgagcaaatctttgtgacgactaaattaccggccgaaacgaagtcatatcaaggtgcactaaatgatttcgatcgctcactgaaaaatttgggcttagactacgtggatctctatttggtacacgcaccttggccatgggggcaagtcggtcgagtttacgatgaagctaacctcgatgtttggcaggcaatggaagctatttatcaaagtggccgggcgaaagcgattggtgtctctaactttgctgttcgggatttgaagaatattcttaaccaggcgacgataccaccaatggtcaatcaaattcaatattacttgggcttcacggaacctaagatcaccaagttttctgaggaacatgccatgcttgtagaagcatactcgccattagcgacgggcggggtcctcgataatccgcaagtacaggcctatgccgataaatacggcgtcagtgtggcgcagttagcgttacgcttcgttttgcaaaatggggtcttgccattgcccaaggctgttaatccagcccatattgaggcgaatacgcaattggacttcgcaattagtgtggccgatatgcaagccttaaacgacttgccagatgcggctggttcatacatgcacaacccaacccaaggttaacgaacaaaatgtttgaccgcacttgggtcgataggagtaaactgaacataattaatgaacgataaggagcgatttgatgacaatgattaatgcagctaacgcgggtacttacgcgtttgatgatcaattcaaagttaaccggatgggttatggcgtcatgcagttaacgggtcctgggacatggggaccatacgctgaccctgaaaatggggtcaaggtagttaagaaagcactggaatatggcgttaatttctttgatacggctgattcatacggtccatggtttgctgaccggtacttagcggcgggcttgaaggatgccactaatcgtgatcagatcttcatttctgataaggtcggtcaaacgcggcaaggaccgaatgtgtggacgccacttggtgagccacggtatctgcgtcagcaagtagaagtttcgatgatgacactggggattgaccatgaagacctagtattcttacatcgaattgaccctcattactcgattgcagatcaagtcggtgaactcaaaaagcttcaggatgaaggtaaaatcaagcatatcggtctgagtcaagtgactgttgatcaaatcaaggaagcacagcaagtcgctaagattgatgccgttgaaaatctctataatgtcgccaatcacggtgatgatgacgttgttgactacgcggcctcacaaaagatggcttttctgccatggttcccattagcaacgggtgaactggctcaggctgggagtgtcctcagtacgatggcccaaaagtatcaggtgagcccagcgcaaattgccttggcttggctattgaagcggtctgataatatcataccgattccaggaacaagttctattgagcatttacgggacaatgtggcagccgccaacgttgatttaacaacggccgattttaatggattaagtcaattaagtgttaaatgagtatttaggtcgggaattcccgacctttttgtttgcctaaaacgagctaaacgacgcttgaaattcatggggttgacggttaaaatgaataaacattgaatgagaaagaggattgagcaaatgagtacgcgtttgatgagtgatgagccaacaatttatttagcaggaccttggtttactgagggccaaccagaacggctagctaagatcgaaaaattaatggacgagttagaattgacttattacagtccacggctagacggcatcgatttgacgccggatgcgaccgaagctgatcgaaacgcggtatttacggacaatgtggaccatttaaaacgggccaagttagttgtcgccgtggttgatggctttgacacgggaactatctgggaaactggaacagcatatggtttagatatccccgttgcttactatggtgaaacgttagctgatggcacgtttaatgtgatgctggctaagtccggcaaagcggttattgagaacatgattgatttgaaggcttttctacaagatcccactgccgatgattttcaatatacaggaactattcgttaatttgaacggttagtcaaaataaaaagtgagccgtctgcatttgtcaaggctcgctttttgcatacataaatggcagaacttgtggtgggaatgagccgcttgaaaaaatgtaatatttgttaaaggcaatgtgtttaattggagaaaagtcatcaaatggtgttacgctatgggcagaaattggttgactgcgcaaatattaagaaagcggcaagaaaacaaaaaagttcagttcaaactagacaagcactatccaagttgtataatgtacttgtaagcgttatcagaacctaattacctattttgggggcgttatttatggttaaaagtaaagcaattatgattggtgccgggctatcaaatatggctgcggcggtctacttgattcaagatggtcattgggatggtaaggacatcacattctatggtgttgatatgcacggtgcgaatgatggtggtgccacgactgattttaccaatgagtattggaataagaatcatccgatggctaacacgactgggtacgttgcccggggtggtcggatgctgaattaccggacgtacgttgacttaatggatttattggaccggattccatcggtaactgaaccggggatgacggcggccgaagatacgcgtgattttgatgcgaaacatcggacgtatgatattgcccgcttgatgcagggtggtaaaggcattattaatgctggtaagttaggattcaataataaggatcggactttgctgactaagttgattatgatgccagatagtgaagaaacgaagctcgacaacgtttcgattgctgagtacttcaaggatgatccgcatatgttccaaacgaatttctggtatatgtgggaaacaacctttgcctttagaacgcaaagctctgctcaagaactgcggcgttacatgcatcaaatgatttatgaatttacacaaattgaacacttagttggtgtcaaccggacgcgttacaatcaattcgaaagcatgattttgccattaattaagtacttgcaagggcaaggtgtgactttcattgataataagattgttaaggattggcaatttaaagacacgccaatgcaagatgaaattacggtgactggcttagtcattgaggatgcgcagactggcgaaacggaagaagttgaagttgatgaggacacagcggtgatcttcactaacggttcaattaccgattctgcaacgatgggtgattacaacacgcctgctcctgaaaatatggattatggtgttagtgctagtttgtggaagaaggctactgagcggttctataacttagggacgccagataagttcttcaacgatcggaatgctagcgaatgggtcagcttcacgttgacgactaagaatcatttattcttaaatgaaatcgttcggatcaccacccaggaacccgggaatgcgttgaactccttcttatcaactacgccaattacgccgttgaaccaaaaggatgttaatatgtcgatcgtggtgcaccaccaaccacactttacgacacagcaaccaaacgaaacagttctgtggggctacttcttgtatccacggcgtcaaggtgagtttgttaacaagccgtatatcaagatgacgggtaaggaaatggctcaagaattaattggtcaactttccaaagtagatccgggtccaggtaatattaaagacaaggaaaaggaaattttggacagtatcgtgaacaatattccggtatacatgccatatgcttccgcactctttaataaccgggctaagtctgatcggccagaagtcttaccaaagcactcaacgaacctagcctttacgggtgaatttgcggaacaaccataccagatgatcttcacggaacagagtgcggtccgctctggtgagattgccgcttatcactttgctggggtcccaatggataacttggtcaagacaccacggtacgataaggatccaaagaccttgctcaaggcaactaagaagatgtttgattaattaaatgctggcctgtcagtggttaatgctgatgatggcatgatttaaaaacgctccccatgaaagatgactttcatagggagcgttttagtgtgcatcacgatcagtagtaacggctcgttgagacgccgtcattaacaggatcaggttgctaagcaatttagtggttgatcaaattttagcagctgctttaggtgttaatttagacggtgtgtgtttagtagtggctttgactgtgagatgctttttggttgcaagtttgggcgcctttttagcgttttgcttggcggtctttttgattaattgtggtgccatcttcttagttttcgttggttgggctaacgtttttttagtggcgagagtcgttacctttttagttggtttgatacttgccttatggtgtttgatcgttagcttcgttgattttactttggtggtcgtctgctttgccaatttgattacctttttagaggctttgattttaggcgttgctttcttagtactggtggctttaggtccagcctgcttggtggtcttcttagcaattgtcaacttagtcttcggggttttcttggtcgcttttaatttagcggtcggggcgttcttcttaatcatcgtggtggctttagcccagccgagggccttaccgtgttcactaatgaggtaatatgtggccgacgtatgtttgccggttgctaaagtaatcgtcttagttaccgtgtaagtctttttagtgctgagttttgctttggccgggctaacaaaggcgattgcccgatcggcggcaaagtgaattgtattcaaagtcgtggcggccttcgcgtgcattgtgatggcggggaagtgggtcgctttagtgagtgcatgggtagtggcttttggggttaccgtggcggcattagccgtggtggtcatggcaaacgggctggcagccaatggtaatgccaaagcaagtgttgcaacgactgatgttaattttttcatttcaaaatcccccttaaagtgaatctttttttgattcggagatagtttagcaccttgactgctttgcaacaatcgtaatatcaataaaattatcaaaaagtgggtgaatttgaatgcaatcaataaaggcttgataacaaacgaaccgcggtgggagtaaccgttgggttaatgagagtgaccgagattttagaactaacgttcgcactgaatgggaaagttatggtatgctagaacggtatttttactgaaaggggtgggcggcattgccggcagcaacaactttaataacccccgctgaaaatcgtttctttctgttaagtgaacgagctcgacggcggaccacgctccaacaaattagtgcgttattacgcgcacacgtaacggtaaaggctgacagtgatttcttgaaaccgactgttcgtaacttgattttacaagatcatgcacagtggttgaccgactgtagtcatgagtggcaacttttggcgagcttgccgtacgttgttaatccgaatgaaagccgacaagcatggcatcattgcgaattgtgtcataagccggttcgttatgagtaccatgttcaaaacaagcataatcatcgtgagttgattgtcggttctgaatgcgtcaaaaagttcatgaacgccgaaacacgttacttgatggtgattacaacagaagataacttttatgcggtggcccagtatcagacgctgactaccgctgtaccaacagtgccaacgatcatgtttgctcagccatggctaccacaattaccggctgagcaagccccccaagcacgcaagttgcgacaaacaacgacgcaaaccgtcacgacgtacctaaaacgtcgtaccaagcaactaccattacaggaactaaagcccgctgaacaaacctatcagcggttagtccatgatgaacaagcggtgatcgaagcggctgagcgggcggcccgtcaagcaattgtgaccaatcaacaacaacgccaggcacaagcgcagcaaagtgctgtgaaggccgagcaaaccttgcgccagagtcacgcctatcaacgttatttacagcagctggcggccattattgtgatgcatccggaacgaccgatggcgaagcaacagtttgaaaaaatcacgccaccagcgaccgaacgccctttggtgaactcttatcaattcgggcaaatggtgactgaatatcgacagactgggaagattcaagttcggcgcctagccatgcttgatcatcagttcgttgccgcacttaatcaggtgactcaacagctagatgaacaacaaacgacgcgtttttatgacgatgtcttcaatagttgttggggctggcagtatcatcagcaggcgacccaacgtgcggattgggagcacttattgacgacccggtggggccaatcattgtcgctggcttggtttgaacaattagccatgcaaacgacgatgccacaaactcaacagtggcttgcggacaatgcggatgccggtatgcaagcagcactacagcaacgtttagctgcgcatgaagaccgccaaccgattgcccgtgaccggatgactagatcggaattacgacagttttgtttgcgtgaacagccagttgcgccgacattagaagcatttgaacaggtctttgaccaacagtatcaattgcccgtcgaccggcaagcaacggcccatgaaacgttagcctattactatattgcgcgtcaatatcaaggcgaccatcagcgtgcgttacaacaactgaattggttattgaaagtctaaatgtttcacgtgaaacataaaaacgtccactgattttttcagtggacgtttttaattcggctgacaggttaactattaatgacgctgtgatagcgcgaggctacaaattcatacagcggacggctaagtggtgtgacctcaacggcttcttcaaatggtgccgtaaccatggtgtcgtcagcgtttttagcgagtttgacggcccaagttggatcataaagtagttgttggcccactgcgactagttcggcagtttgtaacacagtcttgacatcgtcgcgggtccggacgccaccaacaccaactagcggcaatttaccttgtaacgcttcgtgcacataggtcatgatggatttatcttgatactgcgggtctcgtgaaacacggtcatagttgttgagtgagacatgaacgtaatctaatcgactttcccgtagttgtgagagtaaccaaagggtatcttcaaaacgaatacctggttcttcgaattcttctggtgagaaacgatagccaacgatgaagggccggtccgcatattggtcaacagctgcaaagacggcctttaataattcatcaataaagcggaaccgttcttgtggcgtgcgaccaccgtattcatcggtgcggcgattactatgtggtgagaagaactgttggatcaaataggtattggcaccgtgtaattcaatcccatcaaagccgacttgaatcgcgcgccgagttgcttcaccgaatgccgcaatcgttgcgtggatctcgtcaatcgacattgcgcgtggggtctccgcatcgtcacgaagggctgcaacggcactggcagagacaatctgttcgccatttaagacggctcgatgcgtcattcgaccggcgtggaagatttgaacgatagctttggtaccttgactttgaatgccatgagcaagtgcacttagaccgggcagcatcgtgtcatgcgcgatactaagctcgccatgccaccccttaccgagatcttcgacgttggcagcacccgtaatcacggcacctaagccagtagctcgttgtgtgtagtagtcgatttcgtcatgggtgatactaccattgtaaaagctttgagtcgtcgtcatgggcgacatcattaggcggttgcgtagtgtaacgccagatttgaatttgagtggttcgttaaaactagtcacaataaaacatcctttcaagctagttttgcttactttttgtaagatctagtttcagtttagcggttgaaatttgttttttcaattttaaagtcgctggttttagttaatcttggcataacaggatggtgcgtgtggaataaggggattgttgctgttgttaaatcaggtgaggcttgataggtagatgcaaacaaaaaacttcatcgataagcatggtcgacgaagttttttggaaaattatgatgcaacgttatgccttaaacggattccagaaacggccaccgttgaccttaaagagggcgatgccgaggatgatcagcaaagcaactaacgttaacgccagatagtcgttacgtttaaaacgttgggccatgtaccatgtgcgccgttttcccttaccgaagcgccgcaattccatcgcctgactaatggtttcaattcgatctaagcttgaaaaaatcaatggaagcagaatttggatgccgccacgaatacgggtcataaaatgcgcttttttcgacatttcaaacccccgagcctgttgcgccagactgatagtacggtaatcagcttgaacgtctggaatgtaacgtagtgcaatcgctacggaatagctgatacgataggaaataccaatcttattgagactcgcagcaaattcgctgggattagtcgtcatgagaaaaatcagggcgagtggcacggcaaacgtgtactttaataacaaattaaattcataaaatagttgttcggctgtcaagttaaaatagtgatcagcagatcccagtagtaagtgttcggtaccataaatcgagacgccataatgaggcgcaaagacgtacaccatcactaagtttaaaacggaaaaaccaataataacgttaagcacgaacgcgatatcgcggtaatgaatttttgaaaagcggaatagaatcagcgaaaaaatcatcaccccgattaagtaacgcgtatcgtaagtcatcatcccgataactgataagccaacaaagcaaagcagtttagtgctaccgctaagccggtttagaaaagtatggcggtcgttgtacccgatcaataattcatgttgcatcttagcgcgcctcccgttcagcctgaacaaattttgcgacgaattctgtcgggtttaaatggtgcgcttccgctagggtgtataaacttgtcttagctaaggaagcttgctgaataatggctgcgttggtcaacacatcggctgggcgagcatccatcaagatgttgccgtggcccaacacaatcgtgcgatccgtgtattctagcattaggtgcatatcatgcgtgatcaacataatcgtcatgtgttgttcctgattgatcttagttaagaaggtcatcatttcagtatagtgctgcaagtcttggcccgcagtaggttcatcaagaattagcatggctggttctaatacgaggatggccgcaatcgtgacccgtttcttttgaccgaaactgagcgcagaaataggccagtggcgaaactcatagagaccacagaccttcagaacggcctggacacggcgctttacttcatcgtcagcgacacctcggaggattaaaccggcagcaacttcatcaaaaatcatcgttttagagatcatttgattggggtcctgaaggatataaccaatttggtcggcacgttctttgactgattggtcagctagggaacgactgttaaatcgcattttgccggactgtggcatcaaaaatccagtaatcagattgcttaatgttgacttaccagtcccgttttgacccaccagactaatcatttcaccctgatgaagcgtgacggtgacatcgttgatgattggtttggcgggatcatacccgaatgtcaggtgctcaattgcgagtaacggttggtcatgaacgacgggcgcctgtagttgtacgccggcggtccagttttgcaacgtcgcggtgaggtcgggtacttgtaaggcttggaggttatccaagtgttggcaagttgctagatcaacaccggctagtttgagcgctgaaaggtataatggttcgcgcagcccgagttgagtcatgagtgattgccgcaaaatcgtttccggccggtcgttagcgacgatcgcgccgtcttgcatgacaatcagccggtcgattggttgttgtaacacgtcctcgatgcggtgctcgataatgatgacggtcaggtcctgcgtatgagtcagttgatcaatgagtgccatcgaggccttacccgatgccgggtcaagactcgctagcggttcatcaaataataggattttactattgtcgatcagaacaccagccatggcgacccgttgcttttgcccaccagataattcctgcgggcggtgcgtcaataagtcctggaggtctaaagtttgggcccactgttcagttgcttgtcgcatggccggttgggtctgctgatcattttccaatgagaaagccatatcttcgacgacggtcagaccgacgaactggctatcaggatcttgcagtaccgtgccgacgtcttgggataatgcaaaaatggagctctcagtgatggtttgaccagcaatcattgcctggcccgtcactgttcctggataggattgcggaatcaagccgttcaaacaccggcctaatgtagatttaccggagccagaaggtccagcaatcaacactttttcaccgggataaatatccagattaatatcacgtaaagttggttccgtttggctattatattgaaaagagaaatttttaaagctaatgatgggtgcgctcatgttattaacgttcctttgttaagctcccacgttgggtccgcgtccgggcgtacaagactagtaggatggtcccaatgatggcaactgagatggaatcggcgatccaagtaatgacaccttgaaggtaaactttgttggccggttcatgataaataataatatcaccagttggtgctaaaagcacccaaccaataaagttgacgatgatttggtaaatgttaaaccagactaattttgccgttcctagtacgccattttcaatcttgagccgatttttagctagtccgaaggcaaccccaatcagaccatcaacgatgacccaggtccaccaaggcgaaccataagttacgaagtcgtttaaggcgtgaccgatgaacacggctaaaccagctgcaacgggaccaaagatggcacctagtaaggctaaaaaccccatcgcgacgttaacctgggtattcggcacacccgttggaatggcgacaaatttcatgagaacaaaaataacggcggcgccgatcccggtagccacgacggtacgaattgaattggattgcttgttttgcatagtgtaacactccttaagtattgagaatgaataagttctaataaccattaataaaagcgaacaggcgttaatttcagatcagttatggtcataaaaaaacgcgcctaaaagcgaatgctttctaggacgcgtttgcgtgttaccaccgagattttcccacagggacttatcatgatcgtaacggatcgctccgactgagatggccccagtagcttcttcaagaccatcttcaactaaccacgtcatcgttttgcaccaaaaatacgactctctaagcacgagaattagcttactcatcttgtcacagctttttctaatctgaatttaactattaaagcatacgccaaagtctgtgggggtgcaagtaaaaccgaacggatgtagccggttacatcgagattgaacgggaaaatcgggaacagctaattaaatggtggtcaaatgcactgattcattcggctatacggtcagtgacggatgctgatgattagttggattggtcgttaattaaacaaagccaataaaagtatatacaaatgatttcaattagctactaaaaggggtaaactagttgacaagaccaaatgatgaaggggatgtgagtagtttggcttataagtatgaaacgattgcggatagtctgcgacaagacataaaatccggtaaatatacgccgggtgaattgatgcccgaccagaataaattagctgaaacttttgatacgacacgaattacgattcacaaggccattcaattactgattattgaagggatggtttactccaagcgtggcgcggggacctttgttcgcaaggactttggcttgactgaacggcgccaagaaacgctggtagacaagcccctgggaacaacgcaaacgaatgccggtaaaaaggtgacgagtaaggtgttggaattacaagctcgcttgcctactaagcgggaagcggaacagttgttaatcgatgagatggatccggtgtacgttattcggcggacccgctacgttgatggtaaggtgtgggcgtatgagcatacgattatgccaacgagtatcgtgacgttgacgaagcaagtcctcgaaggctcggtctacggttacttagagcaacatagtggcaagaaaatcgcgggttcacatcgtattatctcggcagcccgagtgacggctgatgacgttgccgcaatgggcgcgactctgaatgatcccgtgttggtcattaatcagattagttacatggatgatggtcaaccctttgaagtctccgaatcacatttcccatacgagacaagtacggtcgtagcggatgttcaaattcattaaagcaatcggtaaccgcgttaatcagtggctaccgattttttgtggaaattattctggagagttgcattcaagaaaacggtggcccataattaaattgattgaaaaagaaagcgcttcaataatctgattaagggggatggaaatatgccagctaacttttatcaacgattaattgataagtatgaaccaatgacggaagcagcgttcttagtgttagtcagtgttcgccagccgattaccagtgaagcgattccggcaaagatcgctgaaatgaccaataatcaactacagctaggattaggaaccttatttacgaatttgcatgccatgacgaaggattatttaatgacggaacgagtcgacgaaaatgacgtgcatacctatgaaatcacggggagtggtgaatcggttttggcggctgaacgaaaacgactgcaattattgaatcagatttgtgagcaggcgggattgtaacgggctaatttaacggggaagtgagtatatgtggcgttatcaaatggcggtcaaaggctcagagcaggaattgcggtggctcaatcagcaggcacaacgcgggcaattactgcggcgtatcagggggaactggtatcaatttcaaaaaacagcaactcggtatcaagtctttagtgaatatgtgagcggtaatgttgcaactgaaatcgacgaccagcacacaccgttcaaattgttagcacggctacaattgacgaaaccagccgtacaggtgatttatacgggcacggctcagactgatttgcagggggcgcgagtggatcgtcaggacgcgccgttgcagttgaaaattgcactggcgcaacggggacacttgttaaatgtcatgaatattaggttagtagttggtctgatactagccgtgatcgtgattagcctgaatgtgaatgataacgtggccagttggggaatgtttgcatggttgctatttaccttctatcccgcatggcaagcaagtcggctgcataagcaggcgaatgcgctgcgagtcattacgcaacaatatgatgatgcttggcggccaacgatgcacgttttcttaaaaaacatgcccactgagttggacacagaaaaagtggctggtctaggggtgtgggcttacgtcggtcaagatcatcacgggatgtactggtacgacttgaaaacactggccagcgctgcggaaatcaagcaatcgctacagccagttgtgggagatagcgtttctgtatcgattgtaagctggctgggattggcaccaattgggtttgtttaaacttttaaaatggaagtggtaggtatgtggcggcatcggtttttgatcaaaggttctgaacaggagttggcgtggctgaatgcgcaagcgcagcgacattatttattgatgaccattcatggaaattggtatcagtttaaaaaagtgccgacgatttatcgggtctttagtgagtatgtgccacaagcaatcgcggctgacatgagcaacgggaacagcgcgtttcaagttctcgcccaagtgcaagtacagcaaccagatgttcagattgtgtataccggcagcgatcaaccagcattacagcaaacgacaattgcgccaactgatcctaagattcgtttgcaagtagctttgcagttacgtgatcaggcgatgaatacgatcaacctcagtctttatgcaggggttgtggtatggggattatttttgatactgatccttcatcagggtgataagggtttaataggcgtttggatgctaatgctgttagtaggacttctcgcggtattaggactgtatcggacggcacatcgtttgcagaatcaaatcagccagttacggcgtgacactgaacaggacgacggggcctggatgccgacgatgcacgtttttgtgagcgcattgactgcggatcttgacaccgaggaaccggcattaaagtcgttaggtcggtggaccttagctggtcatagtaaaagggccagtattggtatgatctgcaaacgctagccagtgcgacggagatcaaacagactttacgaccgttcgttgcgactgacactaacgtcaacgttctgagctggttagggctcgcgccactgggctggtttgtgtgattggcaataattgtttgtacaattaacatataaaacgttagactattctgagactaacgttttttttgtgtttaccggtctgatgataatataaatgataaaaagtgacatataatcataatagtagtattctaaataaaagacaaagctggaataggttgagtgttagtgaatcagctgtaaattaatggatattgcgcgaattttactataaaagtttttttattcgtcacaaatatttcatataatcgggttaacttaaatagtacaagctcgattgtgttgaagacaattgagctgattacacagaaagcttagtgaggtgattttgatgcgacttaaggatttaactggtgagactttcagccgtttgaccgttatcgaacgggctgaaagtgcgccgaatggtaatgcacggtggttgtgtcagtgttcatgtggacgacaagtagttgtcgatagttatcggttacggaaagggattacgaagagctgtggctgtttacgggcagatgttagtcgaaagaatatttttgaaaatccgcaaacccgtaaaaatatgggacgtagtgataacttaccgctttatcaaggaacttcggtcgatcgattgaaaccgaatagccggaatcggagcggggtcattggggtttcctttgaccgatgctcacagaagtgggtcgcacggttaatgtatcggggccgcttagttttgaatcagcagtttgctgatatggatgatgccatcatggcacgtaagcaagcagaacaacgctacgttatgccagtgttagaagaatatgcgaaatcaagcgcggattaagacgcgtacataattagcacgccaggagactggcgtgcttttttgcgattattacccgggaaataatcgagttagattaatactcgtaaggaccgattatttgtgtttatggatcgaactagctaaacttaacaggcaatttaaattagaacggaggaactttgagcatggaaatgggattggcaggaaaacgggtcttggtcactggttcgactaagggaatcggacgggcaattgcggtagcttttgccgaggaaggcgcggatgtggtcattaatggtcgccgcgcagatacggtggccgcggtcgtggatgagctcgcagcggcatatccaacaactcatccagtggcggcaccgtatgatattagtgatccgcagcaagctgacaaaatgtttcaacaaattccaacggttgatgtactggtcaacaatatgggaatctttgggccaatggcttacgatgaaattgacgatgcaacctgggaacggttctttaaagtgaacgtgttgtctggcaatcggttggcgaaacattatttacctgcaatgttagcacaagatttcggacgcattatctttattgcgagtgaagaagcagttatgccttcgggggaaatgcctcaatattcgatgactaaatcgatgaacctttctttagcgaagagtctgtcgaagttaacagttggtagccacgtaacggtcaacacggttatgcccggctcaacattaacagaaggtgttcagaaaatattggatgatatgtatgctggttcagatttaccaaaggatcagtgggagcatgactttatgattaatcatcgaccactatcacagattcagcggttgattcggccggaagaaattggtcgattagccgtgtttgtcgctagcccgtttgctagcagtttttctggtgaagcattgcgggcggatggtgggttagtcccaactatcttctagtggctaatgaaggcgatatatcttgctggttctgccatagaaattcagatgtcaaaaaactgttttagcgagtaaagtttatcgccaaaacagtttttttgttgacctgcctagcttcaaaagccggtttcaagcagattagatgcttgaaatgatgtttttaaccgattgactggctagtcattgacttattagtcaacggcgcctatgattgcagcatcaacaataagatgctcgaatttgaaggatgggagtgagtcatatggataaagaaccgttattaaggattagtcacttgcaaaagcatttcggaaagtttcaggcgctcaaggatattaattttgaaatcaacgcgggggaagtttttggctttatcggtccgaatggtgctggtaaatcaaccaccattcgggtactacttggaattttaaaagctagtggtgggcaggcgacgatttttggtcgcgatgtctggcaggatagtgtagcgattcataagcgaattgcttatgtgccaggcgatgtttatttatggcctaatctaagtggtggggaaattattgacttgtttctcaaactaaacggtggtcagcatacggctaagacggacgcgttgatcaaacagttcgaactggatccgcgtaaaaaagcgcgcgcttattctaaaggtaatcggcaaaaggtggccttgattgcggcactctcaacggatgctgagctctatatttttgacgagccaacgtccgggctagatccgttgaatgagcagacgtttcaaaatgaagtgttggctttaaaacggcaagggaagagtgtcctattatctagtcatattctgtcagaagtggaaaaaatgtgtgatcgcatcggtattatccgtgaggggcagattgttgaaacggggacgttagctgagatgcgacacttgacccgaaccacggtcgatgtgcaaacccgactgcctttgactgacttgaccaccctagctggtgttcacggggtcacagcgcgccacggagataaccacgtcagtctggccgtcgatgctgaccagttgacgccggtagtgcagtacttggcgagtcggaaactgatcagcttaacaacgactccaccaacgttagaggatttgttcatgcgctattacacgaccgagcaacaaccggtgaaggggaagtgatgctgatggcaacacaactatttgctcgtaccggattactgatacggtttaacttacgacgagattggaaaaagttgctcatttgggtcgtcgtgttgacgggactcttcacggctatcgccgcgaagtttgatggtatttatggcacccaaactgccttgaatgaaattgttaaaacgcttaaaacacccgcgatgatttccctatttggtgcgttttcggccaaatcgccatatacgacggccaaggtgtttgcaactgaaatggtggtttttatggccatcgtcatgattgtgatgaatatcatggtggccgtggttacgacgcgcggggatgaagatgatggcctgctagagctagtgcgtgcccacgcggtcggtcggttagcaccactattcgccggggcagctgagttaacggcgctaaatggtttgattggttttctttttgccctcgggctgaccgtcgccaagcttccgggagcgacgacgccaggtaattggttaattggtctgggcttaggaggcttaggctgggcttttggaatgttgacgctgttacttgcacaggtaatgactagtgcgagtggtacgacgatgctgagctatttgctactgggcgtcatgtacgttgcacgaatgggcacggatgttaaccgtccagacctgacttggtggatcccctttggttggattgaaaaattagatgcgtatcaaaccaatgattggttaccaatcggtctgtacgtattactgggtcttggttgtttaagtttggctgcagctcttaatgcttatcgggacttgggcgcgggcttagtcgaaccacggcgcggtcggcgacaggctagcggtttattgcggggtcccgtgaccctattatggcggcaggcacatggtctgattattgcatggctactagggaactttatcttaggtgccgcgtatgcgtccgtctttaatacgattggcgatttggcaaagagcaacccaatgatcaaacagttgctgggcgcgtcagctttagcagcagcgaaccgtttgatcgtcaaaaacttcattgcggttctggccattgtcatggtaatcgttgccctgattccagcagttcagctaatgctcaagctggtcaatgatgaacaaaaaggctatctacatcaagtttatgcgacggccacatcacggtggcacgtgtgggcaagctataccggttgggcgatcgtaacgggactgctcgttttactggccggtctaagcggcatgtatttgatgggcctgaagagtatggacaaccccattagctgggtgacctattggcacgtgtttgcggcctatgcaccggcgatgttagtgatggtcgcggtgacgagtgcgctcgcgggctggcgtcctaaatggcggtacgctgcgtgggcctgggtattttacgccttcttttcattatatctgggtaatttgattgatttgccaaaatgggcccgccgtttaacgccgcttggctttgttaacaaggtaccaatcaagcccttagatgggacgacaagtagctggtgcctgttattaactgtgctaatattagtagtagcagcactaagctatcggcggcgagacctagctcagtaaacgaaaggagtgcgcgtcatggcagcaaaacaatcagttccgaaagaccctgcgaaggtcgagcgtattatgcacgcggccatgcacgcttttgccgtcaggggctatcgagatgcaaagacggatgtgattgcgtccgcggctgaggtgtctaagggcctggtatttcattattacggcagtaaacagggcctgtacttggccactgttcagctcgccactgacacaattattgccaccgttaatcaacaagttttcgatgttccagacgacctggtcacattgatggtgcggagcgcgcgttacaaggcggcgtttggacaagaccacccggatgaaatgaaggtcttgatcgacgcgtatggcgcgttggagcgtctgcctgcaaagatacaggcacaaatgaagatcctgtatactaagtcgatgactatttcccgggaaatgattagtcgggtgctggataaaatgtctctgcgtgcggaggttgatcgtgaagcgacgattgacctgatcatgggtgtttacaatcaaattttcacggaatttcaagcctatatgcgcgcagatcatcaagtcgaatcgatggccgatgttgaatgggtggtcagtcgggcgaaaacttacatgggaatcttagaacacgggtttgtcgcgtcaaatttagataatcaatagtaatcatagctattttagcagtcgactggtgttcaatccgggcgactgtttttcgaccaatgggttgggcaacgttcaagcgtgataatgtttgttcgcttttttcgttggtcggctaaaagtgtggtaagttagacttaatagatgacggacgaagtgagggattaggatggaattacatttaacggcacgacaaacgggattgtggcagcgactaatggcactgacacgggaacagctgatgggactcgtaatgcagattgagtcgactgggacaatcgagcgacctacgttaacaacccttgcccagcaattgactttagacgatccactaccggatgaccgtctgagccaacgtatcctaagtgcactagcactggctcaaagctcagccgggcttgccatgagttttgctagtagttggcaagttgaggatgcaatattgacgtttggaaccccgcaacagcgccagcggtatggcgggcaacccgcagtctttggcctcgcggcactaccagagcaagtcacagctagcagtaccgttaaagcaacgccggtgacggctggttggcaactgtctggtaccgttaaagcagttttgaatgttacacaggccactgagtatttagtcctcgcacagacaccaccggatgctgccggagcctttattatcgctgccgataagccgggtgtaacagttggccaaccgatagctccgctagggttacacggattgactatcgcagatattcaactcaccgatgtcccagtaacagccgctgatcaaatcggtcaattgggacaaggacaacgagtaatgcaacgggcgcaaagcctgggacaattatttgccggggcaatcacagcgggaatatggcagcatgctacggaccaaacacgacagttagcgctgacagaacagccgccgttaacagccttggcgccagcaatggcgattacggccgctttacagactagtgtctataatgcggcgcaacaggctgatgatgagcgttcatttacagatgccgcgcaattagcagcggtgtttgccagccaaaacgccttggcaccgtttaaaattttgatgccactgatcggtgatttggcctatacgcaacactcaccgttagtcgccttgcaaaatgacgtggcgacattgccgttgattattggtacggatgcgcagttagccctgacctttgccgcgacgagtctgaacgatgaagtggtcgacgttccgacagcgggtccccaaacggctccggagcacctagtcgtggctgatttacatcgggttgtaaaacgtttgaagctgactaaggatgtgccggtcaatgtcggtagcatcgccacggccaagcgtgtcgtggcattaggccggggggcgatggaacccgcagtattgcttcaagcccaacaactagccaagtggattggcgcggcgctggccgttacccagccgctaacgacgatggaacaattcagcattgagcaacaaattggtgcctcagcggtgacggttgcgccagaagtcttgatcaacatcggtatcgctggtgatgacgattacttggctggcatggctggcgcgcaacacgttctttctgtgaatacggacgaacaagcgccaatcttcaaccattcacaacaaatctttgtgggtggggccagtgaattcttggctggcatggtggcggcgctgaattagcttgaatttcagctcactgtcatttgtacgtatgataattgatagattattagaaggtccaaggctcacagcgagatactgtggcccttggaccttttttgtgtgcaagcgcattaagtaccagtggtcatcacttaattaattaaataattaatgactgctgtcacttaaaacgcgcggttagctggttcagaatcggaattttaaatagggcgatcaagataactgagtagcagacgtaggtcacgacttcttgaatcaagcgcgttgttagcaaaactgaccacggtgttaagtacatgagatggagccagagactgtttaaaaacaaattgagaatgaagacaacgatgaagttggcgatgagaatacgggtcagtgaggtttgatgttgaaaggcgtacccaaagactaacccggtcaaaaaggcggttaggatgaacccagggaaaaaggtgaactttggaaagagcaacattccgagtaggtaggagatggcactactgccggctgtgactagtggtgaaaacaaacgagctgttagaccaataataataaatgcgaaggaaatcttggttagcagtagttgaattgacagtaaactccctaagaccagctgcattgcaattaaagcgccaagtaacgggatgcgtcgaaccgtaagtgatgatgtcataataactgaagccccctaagtgtattgagtgtattttaggggaatttggtgagaattactaggcccgaatttgttggttataagaggtataaaaatatcattgcgagaaacgctacgacctaacatagcgtttctcgcaataatctattaatcctgaatatggctcccgttggacatggaccatagttatcgctacaatgttgataaaaggcagtatggaggcgtttggatggcgtacattacgaaaaagaaaattgcacaagcctttcatgacgtcgtcttagtgaaagggtttagtcggacttccgtgacagcgattatggacaccgccgattttaggcggcaaacgttctatgattattttcaagataaatatgaattattaacctggtttattgatgatacgttgactgagacagttgaacataatctgaattatttaccttggatcgacattattaaactagtttgttacgagttggatgcgaatcgccagttttatgccgagtgtattaatacgcagcatgaaattgacgtgacggcgcttgtcgggaatcacttagccgcgttattgactgaactaacgcatgctaaaacaacggaaacagcggccttaatttggctgttgtgcctgggaattgcgcaatcgctaacgcataatattgttgctagccatcctgaagattacgaggtactttctcaggacgccatcgcagccattgaaatgacacttaaaattttgaactagtttggccaggcggcggtcttgactggtcggtttaaagcagttaaccaggtggcgtccgctaagttaagtagggtcaacgacaacccgtgcatcccgttggcggttaaaaacgtccccactttgttgaagtcgatcgttaatgaggctaggctgagtaactcgtgaacatcattgttgaataccatgagttccatgggcgtcgtcccaccaagtgagttaacgaaaacggcgtaatggtcgccagcatgccacttgaagttgagacgtaatttactaattaattcctgtgcgagtcgttctgacgattggaaagactcgcgtcgataaccgggctcgccgtgaataccgataccgtaatagatttcaccaggatttaaggtaaatgatgccgtcgactgtcctggaatacgggcaccgctagcagcaaccccaatcgtatgaatgtttggcactaaggcggcagcaatgtgggccaattcagtgatagaggcaccttgagctgcggcggcgccaagaattttgtgcactaaaatcgtaccggcgactccccgccggcgctgttttagtgactcgttatctacggaaatatcgtctgccacaatacatagcccggtttgccaatgttctgctcggagttgctgttgagcagccgtaaacgcgcgaacgtctgccggaaagtttttgacgataaagaatgcgcggcgctggtgcgtcacttgtttggtgactttaataatttcttgaggggtcgggggctgaaaaactgtccccatcactgcggcagtcaacataccagccccaacgtatccccaatgcgctggatcgtgaccgctgcccccaccagcaatcaacggaatctgatcatcttgaaagttgctgtcatagcatcccaatgtatttgggacccatgttaaatttggataggcccattgaataccctgagttgcttggctcagggcattttgaggttcattaatgatttgcatggggacaccttcttatattattgatttggttttattataacgcatccgaatgaccatgcttgcaggaagctggcggacaaaacagcgaaactgtccattatttttgaaagcggattcatctacaatggacttgttaattcgagaaaggaagggcaacaagatgaaaaaaattattaatgatcctaagaatgtcgtcgctgaaatggttgatgggttagtgcgcacctatccccagtacctaactaaattaccggataccgaagcgatggttcgtagtgatcaagactcaatgcaggggaaagttggaatcgtcagtggtggcgggagtggtcatgagcccgcccacgccggctttgttggccctggcatgctcagtgctgccgtggcaggacaggtttttacctcaccgacgccagaccaaatttatgcggctattaaggctgtcgatcaaggtaagggcgttttcttagtcgtgaagaattattctggtgatgtcatgaatttcgatatggcgaaagatatggctgaattagatgatattcaagttaaatcgattgtcgttgatgatgacattgccgttaaggatagcttgtatacacaggggcgccgaggcgtcgctggtaccatctttatgcataagattctaggagcggcggctgatcaaggtgctgacttggatactctagaagagctagcaaagcaagttttgccacggattaaaacgattgcggtcgcattatccgcagcgacggtgccggaagtcggcaaacctggctttgaattggcagatgatgaaatcgagtttggcgtcggaatccatagcgaaccaggttatcggcgcgaaaaaatcaagccatccaaacaacttgttcaggaattgctaggtaaattagatgatgaattacacctacagtcagatcatcagtatgcgttcttggttaatggcatgggagcaacgccattgatggatcagtatgtcttttgccatgacttgttggatgaactggcaacccggcacattcaaccggcctttatgaaggttggtaattatatgacttcgattgatatggccggtatttcactgacgatattcgatgttgctgactctcagtggctagattacttacagtatccggtcaaaacaatcgcgtggtcataaggaggaattgagaatgttaacagttgagaatacaaccgtatggctgaataagtttgctgagcagattgaacaacaccaaagttacctgagtgaattagatacgccaattggtgatggtgaccacggtggtaatatggcccggggcctagcagcagtcaaagcggcgctagctacacaacctaccgatctaaccaaactatttcaagcgacagcaatggcgttgattagcaaggtcggcggtgcttccggaccattgtatggaacagccttcttagaaatggcaaaacaaagtaagactgatagcgatttaggtggcttgttggcagcagcgttagctggaattgaaaagcgcggtggcgcaaccgtcggggataagacgctgattgatgtgtgggcaccggtcgttcaggcggttcaagcaggcaaactagcgcaggccgttgttgatgatgcggttgctagtaccaagccaatggtagctaaaaaagggcgatcctcctatctaggtgaacgttcagtgggacaccttgatccaggtgctgtctcaagtggttatttatttacaacattactggatacggagggaatcttatgagtttaggaattgtagttgtttcacacgtcccggaaattgctgcgggtattcagcgtttgttagggcaagttgcccaggacgtttcgattacgattgctggcggtacggatgacgatcaagtcggaactagcctggcgaaaatcacacaagcgtttgatgctaatcgtgcggatgaactcttggccttttatgatcttggtagtgccaaaatgaatctggaaatggccattgaaatgagtgataaaacggttcatctatatgatacggccctcattgaaagtgcctacacggccgcatcgctattacaggcagccgtgccacttgctgacgttgaagggcaattagcgccattaaaaatcaagtaggatggtgacggaacatgcacggttttttaggtgaatttttaggtaccatggtgttaattgtatttggggttggtagtggtgccgccatgaatttaaagggtaattatgcccgtcatcagaattggacctttatttgtttggcgtggggcctagccgttacttttggggtctatgttgctgggcaatttggctcggatggtcatctgaatccagcggtgacggtcggttttgcgttattcgggtatttaccgatggctaacgtttggccgtacttattgggccagttcttaggggcctttgtcggcgcggaaatcgttattattcagtactacccacactttcaagctgcaaaaacggcggcagatggcaatcaagttggcatttttgcaactgggccagccatcagtaacccggtatttaattttctgagcgaaacgattgcgaccttcttctttatcttcgtactattgaatctcggtaactttacccagggattaaagccattgatggtggggctgctcattgttgtcgtgggtcagacgttgggtgggaccacgggctttgcgattaatccagctcgtgattgggcaccacgattagcctacacgattctcccggtccctaataaagggtcggctaattggggttatgcctgggttccgatgtttggcccgttgcttggtggtattttagcagctggtctggaaacaattattagttaaatactcacaactgtgccgattttcttgggcgcagttttttgttataaagtataattaaataaataatgcaagtttatgcaatcgcttgcaataacgatgaaaacgttttatatttaatgagatggattcaaatagatcggggggatcatgatggcaactatcaaggatgttgcccagcgcgcgggtgtttcgccttcaacagcgtcacgtgcaatgcatggtagtaagattatcagtaagccaacacgtgacaaggtcgttaaagcggcgcgggaattaaattacgcgccggattttaatgcacagaatctagcaactaaggccagtaatacaatcggggtggtactaccagtggaccatcacgaaatcttttctaatccctttttcctagagatgattcggggtatcaatgaagtttgtagtaagaatggcgcaatgacaacgttagcaacgggtatttcaagtgacgaactggtgcataatattgatgtcatgattgcacaaggtcatattaaaacttttattttactgtattctgaaaaagatgacccagttgttgaacgcttgaagcaatttgatgtgcaatacgttgtgattgggaagccttaccaagacgtcaataaaacatcgtatgttgataatgataatatccaagccggaacggatgcagcgcagtatctcattgatcatgggcaccggcgcattggtttcttgtattctgatttatcacggatggttcaaagtgatcggatacttggttatcaacgtgtaatgatgcaaaatcagttaccaaatattatgttggaagaacggtttgagactcatgcggcgggtgttaaaacactacataagttttttgaacagtacccagatgttaccgggtttgtggccgtagatgatatgttggcgttgaaattgcaacaggttctccataatgacccggaatggaaagttaaacaattctcactgattggctttaataattcgattttttctgatttagcgcacccgatgttgacatcgattgcggtcttcccgcagcgcttaggagaagaagcagccaagattgcgatggctgaccatcctgctgatgaactatcaacggcagtgattgtgccgcatcaaatcgtgaaacgccactcagtccaccaaatcaaatccttacagtagtaagtgctattaccgaattataggggggtattttgagtatgataacgctaaacgatgtcgcaaaaaaggctaatgtgtcgaaaatgacagtttcacgggtcattaatcatcccgaacaggtacgtcctgagcttcgtgagatgattttaaatgtgatgacgcaactgaactaccaaccgaatgcggcagcgcgagcgctagtagggcgaagaacccgggtcgtaaaattaacgatctttgaagacatggacacgacggaaccctattacatgatgttgcttgcggggattgcgaatgaattgaatcaacatcaatatgccttgcaaattgcgacgcgcaatagctatgaggttggcaagtgtgatggttatattttgaccggcattcgacaagcggattacgcatgggtcgagcgtcttaatcaaccggtcgttttttttggtagcaatcgtcagggatatgactacgtagatactaataattatcaggcggtctgggaaagtacgcattatgctgcagaacagggctatacgcatctcgtttttattggtatcgctgttgctgagccgtttgagttggatcgtgaacggggatttcgggagtacgtcacgacacatcatattagtgctcaaattacccgattgaccaatcactcacacgttgcaactgcatatgtgaaggcccattggtctggctttccccggaatacggcgttcatttgtgccagtgatcggttggcgattggggtcgagacgggcattgttaaccaagggggccagatacccacggaatatggcgttatcggttttgatggcgtgttattaaatcagattgcagctaaacggttgacaacgatgaagcaaccgcttgaagcaatgggacgagctgctgcacggctattgttggctaatatcaatcatactgatcgttcccgtgggttgcatgaccaagaaaaaatcatcattaattcacggttgtcggtggctgaatcgacccgttaaagaggagtctggaagatgagtaagcattggtatgatcaacaaacgatttatcaaatatatccgaagagctttaacgatagtaatcacgatgggattggagatattcctggaattaccgcgaagattccctatttgaagcagcttggaataacgacgatatggttaaacccaatttatcaatcaccccaagttgataatggctacgacgtttcggattactatcaagtggacccaagtttggggacaatggcggacgttgagacgcttattaaaacggttcacgagcacgggatgcatcttatctttgactttgttttgaatcatacttcagatcagcacccgtggttcaagcaagcgctcgctgacccacagagtaagtatcgggactactatttatggcaagatcccgcagccgatggtgggcgaccaaataactggggctcgtttttcggtggcagtgtttgggcgaaggatccaacaggtggcccacagtattacttccatttgttcgataaacggatgccggaccttaattggaagaacccagcagtgcaacaggcgatgcgtgatgttgctgagttttgggttgaaaagggtatcgatggtctccggttagatgcgtttattcatctggctaaagcggactttcgccaaacttatccaaatccgactggtgattcgacacctatcattagtgacatgttttatgcccacctaccgaaagtgcatcagtacttacacgattttgtcgccgcaatcaaagccaagcacccggatacgtacgtcgtcggtgaagcgtcatccgccgacccacacttgatggtcgactatacgacaccaggtacggatgagtgtgatcaagtgattacgttcagaacttttgcggacgacaatactcaggatgatccgagcttctctgatacatttcaaccccggccgatggatgtgacggcctataagcaaaatacggtcggcattcaggcggctttagcagacactagcttgccaacactttactggaataatcatgacatggcccgggtcgccacgcgttacggtgatcctgattatccgcaggcaagtgccaaggcgttagcgacggccctgtacttgcaacgtggtattcccattatttattatggcgaagaattaggattaacgaatatccgttatcatgatattgcggactttgaagatcagacggtacccacctttgtggcaagcgctcaagccgctggtaagtctaagtcagagattatgcggatgctgaatcaaactcataaaatggctgggcgtggccccatgcaatgggacgatacggtttatcatggtttctctgaccacttaccatggaaacatggtgatactgatgacatgaatgcgcaagcagaaatcgctgacccagatagtatttatcactattatcagcagttactgcaattaaagcagcgagctccctttgttgatggtcagttcattatgctcggaagtgcggcacagctctttacctatctcattgatgatgggcaagaacaagcggcgatagtttgcaatttaagtgcacaaacgcaaacgtattcattgccgtttgttggtggtaaagtgttgcttgtacagggtggtgcagcatataagggacgccaagtgacgttaccagcttggagtagcttagtcgttaaatcggcataggcaatgtgagtgcatgattatcctgaaattggtatatataaatcatgtgatgtattttaattaacttatcaatctttatataaattggtataaaggttgatggaccaataagttacaagaaatcgctatcaatttcaaccaaccagtgaactgagctcgccaatcatacgcttaatcctcatgcgtatgccgacgacgtcctaatccaattagtccgaataatcctgctaatccaagtaatactgcaccttgctgtgctgattggccacgttcgcccgtctgtggcagtgtgtcagcaaccgtatcagttactcgtgtcacaggggtcgctgccgctttggctgcgctagtgcgctcattttgggctggtagggctggcactgctgtctgggtgcccgtcttgaccttactctgtacatgagtagccgcggcaggttgttgcttcgtcgtaatctgatcatcaacgaccaagtcgacggtctgaccatccgaatcgttaggtcgctcactcggcttcggtgtttcatcaggatcagtgttgcccgcatgatcattgccgtcagggctaggtgtttcgccgtgatcattgttgtcaggtacagtcgtcccaccatgatcattgttatcagggtcggtcatgttaatgtgatcatcgtcaggtaagacgacggtcaccacggccgttttagttaagtgattaccagcaacatccgtatagcggtaagtcaatgtgtaccgaccagcgtgttgtgtgtcgaccgtaccatcgaccgcgatgtcagctaatgtcagcacttggccctgggcatcggttgcgcgttcgaaattatcctgagcagtccaagtgtttccgacggtcaactgactatcacgcacttgtaactgggcctgactggccaatacattgatgcttgtcatgacagtaatcaaattacccgcacggtccatgtaacttagtgtcagtggataattgccggcctgctgtaagttcaggtgaccatctacagtcacccgctggcgctgcgctgctgtcagcgacgtgccatccgctgccaaactcgttgaccagtcaacactatcattcagtgaccaggtcgtcttaggaccggcaatcacggtaactggccgcgtactgattttggcctgcgtggcaacggtcgtcacttggaccaatgccgtttgcagttgtcctagcgaatccgtgtaaaccagttgcacagtttgtggctgaccaacatgggcaaccgttaagtctggcatcgccacgactgtaatagcggcgttgttgaccgcaatcggctggcccataccatcagtaatcgttccaataccctgatgataatcccacttggcagtcggacccgcaatgaccgtttgtggctgagtcgttaatgctgcttggtcgactgtcaccgtcgtagtcgcagtttttacattgcccacctcatcagtatatgtcagggtgatttgttgtttcccggcctgttgagcattgatggtcgtcatcgtaacactttgataattttgactagtctggccccaggcgtccgttaaaccagtgactagatccgcaaccgttaattttccgacagttgcaggccaaatcacctgatcagcacgagtcgtcatgtgcgcctgtgaggcgactgttgtgacctttgccgaagcagtttgggtcaatcctaattcatcagtgtaactgaacgtaacgacttgaggccgccccaccatagctgtgctcaaatctggacctgtcaacaccttaatattagcatcaccgacattaatcacttcgccggcagcattcgtcacgattttaaagttcgtctgataatcccaatgggcagtcggcccggcaaccggtcgagcggtttgggtcgttaaggcggcttgatcaaccgtcacttgggcagttgttgtcacctcgttgccgtaatcatcggtatacgttagagtcaccgtttgggcaccaggctggctggcattgaccgcactcatcttgacattggtcaaagacgacacctgcgtgccatccgcaccggtaatcgtttgcaaaaagttggctggcgtcagttgccccgcagctttggcccatacaatctgtgccggacgtggcacgagtgccgcctgcgatgccgttaaggtcaaagtagctgacacagtatgcgtctgttgtagatcatcagtgtacatcaaggtaaccgtttgcggcttatcgatcattttagccgtcagttgcgggccggtgataaccgtaattttagcttgatcaggattcaactggtggccttgcgaatccgtaacagtcgccaattgttgccgataatcccaagttatacttggcccccagatttgagtccggttctgactctcaatcttggcctgatcaatcgttacttttacaacggcacttacttcgttaccagccgcatctgtataagttaatgagacgggttgaacacctggccgggtcgcgtctagcttagacatctgaacgatttgataatcagtcaccgcttgtccagaggcgtccgttaagctcgttacaaggtcattagccgttagctttgccgctgcatccggttgcaggataactgctttcttggccgttaacgtagcttgtgaggcctcagctgtcaccattgccgtggccgactgtgatttcccgagctcatcaatataaatcagcgtaatcagctgttgttgcccgactgaatcaacactcaaatctggcatattcagcactttaattgtccccggttggacggtaataagttgtccagctgcattcgtcagctgactaatacctgcttcgtaacgccacgttgccgtcgggccagcaattaccgtgcttggttttgtcactagctttgcctggtcgactgtcacattggcatacgcgacggattgattacccgcaacatccgtgtaagtcaacgtcaaacgttgctgtcccgctaacttggaatccagcacactcattttgacattgtcgtgatttgtaatcacatgaccttcagcatcgtataaacgatcaactaagtccgttgccgtcagttgtttagcttgatcaggccaaataatctggtcagcaacagccgtaatcttcgcctttgaaagcgtcgtcgttacaatcacgtcggtcgtgtgaactttacccagactgtcagtataggtcaacgtaaccgtttgtggcttgccagtttttgccggagttaaatcaggcgttgtggctgtaatgtcagcagtatcgacatcaattgtctttccgttggcatcgataacttgagtcacgctgtcccggtaatcccaagtcgcggttggaccggcaattggatgtgtcgcttgaccagtgatggtggccaaatccacggtgacagtcgtctgagcagtcgtctgattgccatacgcatccgtatacgtcagtgtcacggtttgcggcccgatagctttaggatcaaaaccgctcatcgtcacatcgccaaaattcgtgactttgtttcccgccgcatcaattaattcgctgaccaactcagttaccgtcagtttttcagcttcatcaggcatgataacctggtcggctacagccatgatcttcgcctttgaagccatcgtagtcaccgtaacatcaattgtatgagtttggtttaaatcatcaatataggttaacgtcaccgtctgtggcttgccaacctttgctggagttaaatcaggcgtcgtggctgtaatgtcagcatcgccgacatcaattatctttccgttggcatcgataacttgagtgacgctgtcccggtaatcccaagtcgcggttggaccggcaattgggtgtgtcgcttgaccagtgatggtggccaaatccacggtcactgtcgtctgagcagtcgtttgattgccatacgcgtccgtatacgttaacgtcacggtttgtggcccgatagcttgagcatcaaaaccgctcatcgtcacatcatcaaaattataagttcgaacaccatccgcatcgtacagtgccgacactagcgacgacgcagttaccatgttcgcgttttccgctaaaattacttgcttggaaacggcagtaatggccgcttttgaagccgtggcttcaacattggcagtctctgtgtgcacttgccctaaatcatcagtatattcgatcacgattggagaagtaccagccacacttaaatctggacgctgcacaaccgtaatcttggcatcgcttaatgttagcgactggcccttagaatcagtgatggctttgatgttatcagcatagttccaagtcgccttaggtccggcaacttgagtgtgattttgaagcgttagcgttgcgaaatccacggtcactgtcgtctgagcagtcgtttggttaccatacgcatccgaatacgtcagcgtcacggtttgtggcccgatagcttgagcatcgaaaccactcattgtcacatcgtcaaaattcgtagctttgtttcccgccgcatcaattaactcactaaccaggtcagttgtcgtcagcttttttgcatcatcaggccaaataacctggtcagcgacagccgtaatcttcgcctttgaaagcgtcgtcgttaccatcacgtcggtcgtgtgaactttacccagactgtcagtataggtcaaggtaaccgtctgaggcttgcccacctttgccggagttaaatccggcgtcgtggctgtaatgtcagcatcgccgacatcaattatctttccgttggcatcgataacttgagtgacgctgtcacggtaatcccaagtcgcggttggaccggatgtgtcgcttgaccagtgatggtggcgaaatccacggtgactgtcgtcgaatcagtcgtttggttaccatacacatccgtatacgtcagtgtcacagtttgtggcccgatatctttagcatcgaaaccactcattgtcacatcgtcaaaattcgtggttttgtttcccgccgcatcaattaactcactgaccaggtcagttgccgtcagctttttggcttcatcaggtatgatgatctgatcgccgacagccgtaatcttcgccttcgaagccaccgtgttgacaaccgcagtgactaaatgttctttgcccaactcatccgtataactgagtgtcaccgtttggtcatggccgaccatcgcaacacttaaatcaggttcagtaacgactttaatatcagcggttgcgagattatcaagcaactttccattagcatccttgacccattccaaaccagctagatagtcccatttagctttgggccccgcaattggattcgttagcttggtcttcaaatctgattggtcaaccgttacttttgcataagctgtcactagattgccagcttcatccgtataagtaatagtaacggtctgcgcgccacccttgctcgtgtcaattgaactcattgtgacatctgttaggtcggtgctggtatcgacggggctcccgttagcagccgtgattgtcaccaaatcggcaacttttaattgggcagcctcactgggccagaccgttaacggcgccttggctgtgacttgtgcctgagaagcaacgactgttacttgagttgggacgctgatgacattgcccaacgcatccgtatacgtgagtgtgacagtttgcgacccaatctgcgttaaatcaggttgctgatcaaccacaatgttaagtccgtctaaactaaccgggtccccatcaaaatcagtgacactcgtgacatactggcggtagtcccaacttgagtttttgggtcctttaatgatggtactattacgcattgttaagtcggccttagttgcgaccatcgtcactgtggtggttgtcgtgtggaccatgccagtggcatcatccgtatacgccagcgtaaccgtttgcgcgccagctttactcgtatccaagcctgaaaccgtggccgtcgcgagttcgtcggcacttagcttatcgccagctgcattgtgggagttgtccgtgtcgattaaatcactcatcgtatatgtcggcttagcacccattttaatcgtcaatggtttaccaactagtttgccttgatttaccgctaccgcaaccgtactagtttgctgccatactttgccatacgcatccgtgtactgcaagtcaacttgataagtaccagcagtttgagtgtcgaccgtcgttacagcagtatcgccgttcactttaatcactttgacaacagtgtcagcggtcgcataaatatcagtcccattcacatcttttagtgttgcaacactatcggcaactcgccaggtcgtcttcggcccggcaattaatccggttacatttttggacgtgaaatcagcataggatgggctagtttcccagacccaagtgattgtatcggctggattatcgacgccattatacaaagccattaactcactcgacgtatacgtctgggtggcatcagcttgattgacccatttaccggtatagccagttccagttggaatgtctggcaatgaactaccgactaaatatgtttttgacccaaccgttaatgcgtttaggttcatgggcaacggattcccgctactatcttgattcaaaaacatatcatgatctgcaggttccttattcatatcagcttcagtgactgctgcaaagttagacatgtccaaactcgcaatgttgattgcctttaatccaggggttccctcaaacataaacttagtactagttaacgtactgcccgtctgccagcccgttatatcaagatcagtgagattggtatcatttaaaaacatcgatgacaacgatgtaacattcaacaagttccagccatgtaaatccgccgttgttaaactcttatctccattgaataacccatctatatccgtgaccatccgcacattccaagtacttagatcaatactggtcaaggccgtgttaaatgaaaacattctttttaagctcactggttgaaccgtattcaactgccactgacttaaatcataagattgaactcgcgagtcactggcgaacatagagtcaaaggacgtaccagaactgacattccaatgcgctaatcctgagaagtcagcaatcttagttcccataaacatcattgaaaagtcagtgactttcgaagtatccagattttcaaggccatcaatactggccaaatttggattataccggaacatataactagtatcagtccccgcattaattggaccatcaatcactactttcgttaactcactgccaaaatcccccggtacgtcgctgacatcacccactccggtccaatcaccagcatgaatcgtcaacacaccatcatctgtgtactgccaggcacttgttcccagagtcccagttgagacaacaattgcgggtatggcggctcgcgctaatagtgcccgatttaactggactttatcgttagtcgtcgtaattgtattagttgtggcagttacaactatcggactagtttctgaatccacaactttttcagtttcattagaatctttcgagtctgagtcaccaatgctggccattgtgctagtacttggcgatgcgacacttgaacgattagtttgtagtgattcatcagccaccaccgtgtccgtcacattagattgaatgccactctcagagcccgttccttgatcattttgataatcagaattttgtgttgtgactttctgtgaactcgatgcgacacttactgagctgtttgacgtttggtccaaactgtcgccagaaccagttttagcctgactgcttgctgatgccgaatcagaggtactgagattactggttgcgttttcattttctcctactgccgtaaccggttgttcagcctttgagtcagtagtggtgccactaaccgcctgttttttttgagcactagtatttgttgttgccgcattaatcgccgtcgcactagactgagtcgttgcccctgttgtactagtcgtagtagtccttaaaacctgtgagttggatgatgaggatgccccagcagtggtcgtagctgcggtggctgcggtcgtcgtttccgtatctgcccgacttatcagtggattcagagtaaaggtagccacggtaataccagcaaatacccagaaacgtccctttttatacattttataatgctgcttgctcgttataaatctattcatacatgtccccccaagaatccatgcaataaatcatatcaaaattaacttattatcaatttgagttatactaaatctgattaatatcagaataataacattctccaaagtttagtatcaattatatttattgaatcaattaataaataacgcgtttaactatcaatacaattatatgctaacataattaccagctaagtcgcaagtgcttgtacccgacctttcgcaaaatatttatagcctgataaccattttgctagtatctagaacatttataacagtgagcactacatcagtacatataaaatatatgctggccgtcgtccgtccacggcacagaaccaccaacaacacatactaaaaaaggtcttccaagaatcgaattaattcttggaagacctttttatgacgctgccatactcgttgtatggtgcagcgatgcaacgctaacgtaatcgatgcctagtaatgtttcataacccggtcgatttgacgctgttgttcgcgtttcttgatatcttgccgtttgtcgtattcccgtttcccgtgagcgactccaattaagactttcgcaaatccatgcttgagatacatcttaagtggaataatcgtcacacccttagtcatcgttgctgcacctagcttactgatttctttcttgtgcaacaaaagtttccgggaccgcaacgggtcaacgttataacggttaccctctttaaacggactaatgtgaacgttttgcatccaggcttcaccgttgcgaacttgaacgaaaccatcctttaagttgacccgccgatcgcgaacggatttgatttccgtccccgtcagcgcaatgccagcttcataggtttcctcaacagcgtagtcatggcgtgctttccgattttgagcgagggcggtatctgggtgcttaccgtgttgtttggccattgccgcacatccccttacttaaaaattaacgccgacgatcagttgatgaccgccgattgttgttagtactatgattattattgttgctattatgattattattgttccggcgaccattgctattgccattacgatggtcgttattccggttattattgttcccatttcgtcggtagttaccgttattgccaccacgccggttattaccacgatagttatcatgatgttcccgctttggcaataaatcagtctttggcgcttcttcaggattcaataacttaaagtcgacttctcgttgatccttatcgacccgcattagttgaactttgacgggctggccgattctaaatgtccgtttcgtcttacgaccaaccaacgctaattgtttttcaacgtattcgtagtagtcgtcgtccatcgtactgatatgaactaagccttcaacggtattttctagttcaacaaacagaccgaatttcataacggaatcaacaacggcttcaaacgtctcaccaacgtgatcagccatatattcagccttcttcattgaatcaacgtcgcgttcagtatcaatcccccgccgttcatgatcagaagtcgtttccgcaatatttggtaagttatcccgataacgtgcccgggcttcttcaccagtgccgttttcagcataatggcgaatcaaacgatgaaccatcatatctggataccgccgaattggtgacgtaaagtgagtataatacggtgccgccaacccaaagtgaccaagcgactggtcagcgtaccgggcctgcttcatgctccgcagcatcatgactgagaccatggcttcttcgggcttaccagcaaccttcttcaaaacgtcttgaagcatcttcggcttaacatccttagaactccccttgacactgacaccaaagttagtgacgaattcaaagaaactaagcatccggtcactatcaggcgtttcatgtacccggtagataaacggtaccttaagttgactatagttttttgcaaccgtttcgttggctgccaacatgaaactttcgatcattcgttcagctaagccacgtacccgtaattgaatgtcaattggatgaccggcttcgtcaacgataattttagcttcgttatcatcaaaatcgatcgcaccacgatgccgccgatgcttgtacaagatacggtgtaagtcgcccatcgtatcgaacatgtcgaccaagtccgcatacttttcgcgcgtcttggggtcatgggcttcgagaatctgattaacggcgtcataagtcatccgggcgtgtgaccgaatcacactttggaaaatcttatggttaacgatttccccagtttgatcaatttccatctcacaactcatggctaatcgttcaacatcaggatttaaggaacaaatcccgtttgatagccgccgtggcaacattggaatcacacggtcagttaagtaaactgacgtcccacgtttgaatgcttcccggtctaactcagagttctcggtgacataatggctaacatccgcaatgtgaacgcctagatggaagtttccatttggcaagcgccaagcaacaactgcgtcatccaagtctttagattcggcgccatcaatcgttactaatggctggtccgtaatgtcgacccgaccaactttttcttcatcagtcacgtaatccggaatccggttggcttcatccgtcacttcttctggaaacactgatgggacgtcgtgttggtagaccacttgtaagacgtccatcccaggatcatcaacactcccaatcacctgcttagcaatcccaatcatccgcgttggatgctgagcatcaggataagcagccacttcagcaatgatgacttccccttcagttgggtgcaagccttgatcagtgatcaataattgatatttggataacttcttatccttgattgcaacagaaccaataaacccggcctcgtccgtacttggtgtatacgcaccgacaatctgggtatagttccgtttaacgatgctgacaattttaccctcagggccgcggtcggaaccgggacgggctggtcgaatgatttcaaccgcaacatcgtcaccggtaatggcaaactgcgtattgtccggattaatgtaaatatcaggcaaatcgggatcgtaacgaacgaaaccaaagcccttgtcattaccatgaaatgaaccttcaacagtcttcgtttcctggaccaacttgaaatgatcatgatcatcggtactaactaattttttacgttccatattcgcaagttcttttactagaaaagtaaacgccgttgcgcctgtaaaatgcagttcatccgttagttgttcaacactatacgtgcgatcgggatgagcctgcaaaaaagtcaggatttgttcttgtaagtttgcttctgacattatttacctcatttataaatagtttttaaatatgttaagacatcttgttccaattggtgatgcgcattgttgacggtaatcacgtgtccagcatcagcgtaccaatgaaaatcaactggtacttgtggtaattggtcacgtaaccgccgcgcgaccgtcgcatcaattaattcatcttgcccaccctgaccaataaagaaaggttgggtcacagcattaaggtgacgcgtgacctccgtcgtggtgaaggtgttgactgcctgtagttgctgctgaaccaggtccggcaacgtcattaagatctgttcacgctcggcaattgagaattgactgtgcgccagctgatggtgactcagcgtgatgaacatttcagcaacgtcactacgattgccagcaaatagtggtgaactgaacgtgccaccacctaacaactgagaatcacgttccaaagccgccgtcgcaaaaatgccacctaatgataagccaaagatactaattttagtatagcctttttgccgcataaatgatattgcttgttgcgtatcttgccaccattgcgccggcgtctgtgcgagaatatctcgtggatcatcagtcgcgtgtccactgaattgggggccataaactgtataatcttcccgttctaatgctcgtgctaacatccgcacatcgttggcactccccgcataggcgtgcaataaaatgacggcgtgttgcccatgttcaaagaaaaacggttccggttgtttcagcatcattacaccaccttaaaaaaaagcctcctgaaatcacaggaggacggtcaattacttcgatgagtaccatgctagagctaacgccaggataaagaatgcgattcctaataccacggttaccttctgcatgaacgcttcaaaaccgcggggcttctgcttggcaaacaagtcatcagcaccaccggttaatgaagacatggcatcattagttttggatggttgcatcatcaccgcaatgataatcaaaacggaaacaaccagtattaacgttaacaataaattatacaagaaatgtgcctcctaaagcctccgctatgtctataacaatttaacatattttgccttatttttccagtatcctgaacaattcgttggtttattcagcactcagggcgttgcggccgttaaatgcgcgatttggtgccgcacccacgcgcgattatcccgatcagttaggataatcagtgtatcaccggcccgcatcaaggtgtccccatgtgggatcacttggcgctctccacggcgaatggcaatcaataacgactcagctggccatttaaaatcacgcacttgatgcccctctagcttagagccttcaaagatcggcaattccaaccgatcctggacaccactatgttccggcaaccggggctgaattaatttctccagcaaggcctcataaatcggggcgccacctaaaagatccacgactaagtaggccgtcatcgaaacgactgctaacggcatcaagtgatgtagtgtcccgaccatttcagtaatcaataaaattgcagtaaacggtgctttaccaataccggcaaagtatccagccatggcaaaaataataaaattcggaatcaagctcgtcggcatccaaccaacgacaaccatgaactgggcgtaaatcgcacctaagatggcgcccagcgacaggattggcaggaagatgccacccggtaaaccagacccatacgagatggttgaaaaagtaaaccgtaagacaaagattcccaacaaagcgactaacgccggtgttattgccgctagattcaagataacagaattgccgccccctaatagctgcggccacattaatccaatcggaatcaccagtaagaatggcaccaagccgtccaaccaactgggcaaccgcaacttggcataccaattcggcatcgtcagcgtcacgttttggtacagataaccgaacacaccaagaaagattccgagtccaatcagattgccatattgactcaacggcaggttatgatcgtacggaatgtgcaatactggcaccaagccgaagaaattcagggaaataaaattactggccatggcgctaaccaatgcagtggtccaaatgattggtgaaaaattatgataaacctcttccagaacaaataacgtactggcaatcggtgcgttgaacgccgctgaaaggccagccgccgcaccgccagcaattaaggaacgtcggtctgaaccagtctgcttgagcttcgacgcaacaccctgaccaatcgtggctcccagttgaatcgaggggccttcgcgtccaaggaatagtccagaaccaatgcccaaaacgccaccgacaaacttacgccagagcaccgaccaccaaccataatcaagctcaccggctaactggccctcaacttgtggaatcccagagcctttaatatttggttcctttttaactagccagcccacaaagaacgccacggctacggacagaccaatccagggaaagagcagtaaccagttcgtatgaatctgggcgtacacccattgaacgaactttagtccctgctcaatgctgaaacgaaaaacactaaccacgacacccgcaatcacgccgacaatcagtgcccggccaatcgagctgaaccgtgtaaaatcaaaatgttgttttgcaatgtgcggccgctgtgccaccatgagtccccctcttagttatgataatcgttgtgcaatcgcttgctggacggccgtcaacgtcacggtcgctccaggaagtaatgtctgaatctgctgtgggccatcaacgcgtaatagcaaacctagtaacagatctgtctccaagtcgtcagtttgataagtttccttaaatccggccaacaagtcggtatcatcattaaatgcttgcaaaatcagtggaactaattccgtttgtttggcagcttgatgggcggcgctgaaccgctgtaaacctaattcaccactagtcacaattaaattatcgcccactagattgccatgaacaaactgattaggcgttacggtgtgtacttgtagccaggccgtacgctcggcaacaaagtcacggcccagtgtatcccactcggttgattgggcagcggttggtccaaatgcaggaacttcagtattaagtcgcgtcaacatcgtcccaatctggcgccccagcgacttagcaaggggcttagccgtcgcacaaaattcagttagcgtcagaccttgtaacggctgataaatcacgtagtagaactggtacttatcaaagatgaagcccgcatgcaatagacgcggcgcacccaagcccaaccgagccatccgggtcagcccaaaacgttccgcctgataatgggcccgagtctggggagcaacctcactgggtgggaaaatcgcaatttgggtgggtccgaccgtaaagcgggcggccaacttatccgcaacgggttctggcgttttataaggttcattctcactggtatagattttttgaatcaccgattcaaaagcaccagcattcaattgcagtccttgccaatcagaccactcattaatttgttgctgaaagtcatccattctgttctctccttactcaaaatacgcatgtttctattttaccacgactcgtccgtccctatactccaaactcaaacagatgttccttaaattatgtataataaaaacgccgtcccatcggaacgacgttttcattagaacttcaaattacttgctagtaatggtgttccgtgcagcttcgtctaagttgtagaaaccgtggatacctttgtattctgaagtgctttcaagttggtcttcgatccgcattaattgattgtatttagcaatccgttcagtacggctcattgaaccagtcttgatttggccagcgttcattgcgacaactaagtcagcaatggtcgtgtcttcagtttcaccagaacggtgagaaacgatagcagtgtagccagcttctttagccatttcgatagcttcaacagtttcagtcaaagtaccaatttggttaaccttgattaagattgagttagcaacgcccatcttgataccctttgcaaggtagtccgtgttcgtaacgaataagtcgtcaccaacgatttgaactttcttaccaagcttggcagttgccatttgccagtcttcccagttgttttcatccaaaggatcttcgatagaaacgattgggtacttgtcaacgatgctgtcaagtaagtcaacgaattcttcggcagtaaatgattgaccattttcgccttcaccctttaagtcgtacttgccagtttcttcgttgtagaattctgaagcggcacagtcaaaggcaatggcaatatccttaccaggcttgtaaccggcacgttcgatagcttcaactaagatttcgaatggttcttcgttgttcttcaagtcaggtgcaaaaccaccttcgtcaccaacggcagttgagtaaccgcgttcgttcaagatcgctttcaagttgtggaaagtttctgaacccatccggatagcttctttaactgaagaagcaccaacaggcatgatcatgaattcttggaagtcaacgtcgttgttggcgtgggccccaccattgataacgttcatcattggtgttggtaaaacgtgagcgttgaatccgccaaggtagttgtataaaggcatttcaagttcgtcagcagcagcacgtgcagcggcaatggaaacacctaagatagcgttagcgcctaacttagctttgttaggagtaccatctaacttgatcatagcttggtcaatggcacgttggtcagttacatcgtaaccaacaatttccttagcaattaacttgttaacattgtcaacggctttagtaacacccttgcccatgaaacggctcttgtcaccgtcacgtaattcaacggcttcatgttcaccagttgaggcacctgaaggaacgataccgcggccaaatgcgccactttcagtataaagttcaacttcaacagttgggttaccacgtgagtctaagacttcgcgagcataaatatctgtaataatagacattaatttctctccttaaaattggcttgttatttgtttcacacttattgtagaagtttgtcaatcaacttgcaataactattattagttattttggtaattaacaagttccaagaatgaatcaggttgtaatgaagcaccaccgactaaaccaccgtcgatatcatctttgcccattaattcgttaacgttggctggtttaacactaccaccgtattgaatccgaactttatcagcaacttcttgtgagtaaaggtcagcaacagtcttacgaacaaccgcacaaatttcttcagcttggtcactcgtagccgtcttaccagtaccgatggcccagattggttcataggcaattaccaatgaacttacttggtcagctgataagtctttcaaagcagccttgatttggcctgaaacccatgattctgcttcgccggcttcacgttgttctaatgattcgccacagcaaatgattggcttcatgccgttcttgaagatagcgtgtgcctttttgttaatgtcttcgtcagtttcgtggaaataaccgcgacgttctgaatgaccaataacaacgtaatcaacgcctaagtctgctaaagcagctggtgaagtttcaccagtgaatgccccagcatcttcaaaataagcattttcagcagcaatctttaaatcagaacccttggcagcttcaaccatttcttgtaagaaaagggctggagcagcaacgactgattcaacttttgatggatctggtaattgatccttaacagcattaacgaaagctaaagcttcgctagccgttttgttcattttccagttaccggcaataataggtgtacgcacgataaaccttcctttcggagaacagattatttttcagaaatagcagcaataccaggtaattccttaccttcaaggtattcaagtgaagcaccgccaccagtagagatgtgggttaacttgtcgccaacgccaagttgcttaacagcggcagttgagtccccaccaccaacgatggtcgttgcgtctgataaagttcctaagaacttaccaatttcaagcgtacccttggcgtagttgctcatttcgaagacacccattggtccgttccaaacaacggtcttagcgtcgcgtaaaacgtcttcgaattcttcgactgacttaggaccaatatctaaggccatgtagccatcaggaattgaaccttcaacaaccttgctaggaacatcgttatcaaacttttcagcaacgattgagtcgctaggtaagactaacttgtcgccagctttttcgatgattgacttagctaattcaatcttgtctttttcaacaagtgagttaccaatgcccatgcctttagcagcatagaacgtataagtcatcccaccaccgatgatgatcttgtcagctttgctgattaagtgatcgataacaccgatcttatcagaaaccttggcaccacctaagatagcaacgaatgggtgcttaggattgtcaaccgcgtcacctaagaacttgatttccttttccattaagaaaccagcggcaacttgatccatgtttgaagcaatcccaacgttagaagcatggctccggtgagcagtcccgaaagcatcgttgacgtagacatcaccaagtgaagcccagtacttgcctaattcaggatcgttaccagattcgcgcttaacttgttcgccgttaacaacgtcttcaaaacgagtgttttcaacaactaagacgtcaccgtcgttcatgttgttgatggcagtttcaagttgttcgccttcagtaacaggtacgaaggtaacaggcttgtttaataagtttgaaagacgttctgcaacaggacgtaagcttaagcccttcttgtcgtcttcgctcttaatccgacctaaatgtgagaataagatggctttgccatcatgttcaatcacgtatttgatcgttggtaaggcagcgacgatccggttgtcgtcaccaattttgccgtctttaattggaacattaaagtcgacacgaattaaaacttttttatctttaacatctaaatctgaaacgattaatttagccaatgttaaaatcctcctagaattcgtgactgctgaaattaaaaaaacggcaagaggagttttgcctccccccgccgtcaaaaccatatgcggttttaaagttcttaactatctaatcaaatattagagagtggcgaacttcaataaagtacgtaccatttggcaagtgaagccgtattcgttatcgtaccaagcaacagtcttaactaattggttgtcaccatcagaagtaacttctgtttgagtaggatcgaagattgaaccgaaagtagtaccgataacatcagatgaaacgatttcgtcatcgttgtaaccaaatgattcgttaccttcagtatgcttcttgattgcggcgttaacttcgtcagcagtaactttcttgtctaagatagcaactaattcagttaatgaaccatcaacaacaccaacacgttgtgcatggccttgtaatttaccgttcaattctgggataactaagccaagagccttagcagcaccagttgaatgaggaatagtgtttacaccggcagcacgggcagcacggaagttaccaccacgtacagggccgtcaagtaacatttgagttgaagtgtaagcatggatagtagtcatagtaccaaccttgataccgaattctttgttttcaaagaatgctaatggtgcaaggcagttagtagtacatgaaccagcagaaacgatacggtcatctgcagtcaagatgtcatcgttaacgttgtaaacgatggtcttcaagtctgagccagcaggagcagaaatcaagacacgctttgcaccagcgtccaagtgagcttgtgacttagcctttgaagtgtagaaaccagtacattcgagaacgaagtcaacaccgtcgttcttaacccaaggaatattttgtgcttgtggttcagcataaacacggtagttcttaccgttaacaacgattgaatcgtcggttgctgaaacgtcagcgttcaaagtaccatgagttgagtcatacttcaaaagatgagccaacaatgcaggtgaagttaaatcgttaatagcaacaacttcaatatcacttgacttttcaccaagttctaagatacgacggaatgctaaacgaccgatacgtccgaaaccattaataccaatttttacagacatactagaatttcctccttgtggaaataaaaatagttttattttaaaaagcaacttcactatagaagattacttttttaaaatcaagttagccgcaccctcatccgtgatcaaacacgtctgtttaggtgcaatgttcttcatatacgcggcaattgcggtggcttttgaagccccacccgcaatggcgagtataatctcccgatgggccagttctccgatttgcaatccaatccgcggaatccggtagaccacgttacccttcttatcgaagaagtaaccaaaggcttcaccaatcgcttcacgactgcgtaacaccttgatctgatcctcagacatattccggcgatgggccattgaaatggcttcaccgatactatgcacgaccacgttggcctgcccgataatcgccagcacctcttgaatacttggttctttgaggagtggttcatacgtccgttcactgacctgttctggtacaaacaacgagcggaacttaccgccagtatgttgtgccatttgtgacgcgatggtatttgcttgaatcgcaaccgattcaccaacaccaccacgcgccggaacaaataacaaatcacgtttatcacctaatttattagttaagtgacttgccacatgttccatggtatgcccacccataacagcaataatattacgcccttccggcaataattgctgtaatagctggttcacttcttcgcccatggtcccaataactttcaactgtcgatcggaatcaccagaaacgatgatgcaacgcttaatattaaagtattgcgccaactgtcgttctttctggcgaatgcccattagctcatccataaaatgacttaggcctactaacacgtcctgaccttgctgggtaacttgcatgcccgatttgtttgtcataatcaaatctagcttccgcaatgtatccgtttcggtccgtaacgtccgttcgctaacacccaacgtctgagctaatagccgacgtccaactggggccatccaattaatggttcttaatactaagtaacgacgactcagcatgtcaaccatatctggggcaattgcctcaatccattgaatatctgaatgcatggcatccaacctgctctctagtgggacgggtctggtccagctatgtcgaaaagcgacccaaagacttcaaaaaacaaagcacacaacgcaaattcactaagaaatcaatgttgcatacctctcttaccacaacatgaattataacaggttcataaggtggttgcaaatgaaaccccaattaaacttataaccgactggtccaaatggcgcgttaaattatcgttcggttctcaagtattgttttcgccttgatgacgacggaatgttaaggttttcacgatatttcgccactgttcgtcgggaaagttcgacattttccgcattaagaatctgaacaattttttggtctgaaagcggtttttctttattttcttgttcaatcagggtcacaattcggtgttgaacactgtcggctgatacgattttaccaccagtgggacgtttgctgaccgctttggtaaagaaacgtttaagttcgaacatgccaaagtccgtttgaatgtactttccattaatactccggctgatcgttgactcatgcacttttaactgttgcgccacatcgcgcaacaataatggttgcaaatccgtcgtcttttccagaaagaagtccgcctgccgctcgataatcgccgttcccactcgaaaaatcgtcgcttcacgttgctgcaaactgctggcaatccagtcatactcgttcttcttttccttcaaatactccgtcacttcttgatcatcgtgctgccccatctgctgatagtaccgactgcggaatttaaccacgggctgtgccatggacgcggtccgcaacgccagctggccgccttgattcgacacgaccaagtcaggaaaaatatagccagtcgtctcctgaccgattgccgcaccgggtacgggagtcagtgttcgcacataatcataaatacttgaaatatctgcaagcgtcacctgatacttcttagccaacaagtcccattgccgattaaccagctcgtcaaaactttcttccaagacaatgtaggctaagtttggtgcatgatcatcattttctgtctgcaacatcagcgcttcctgcaagctacgtgcgcccacacctggtggatcgagttgttgcaataaagtaatcgcatccaataactcaattggtgtcgcaccagtttcttgctggacctgggcatcgtcaatccgtaaataaccgttcacatcaacgtactcaattaagtaaagtacgatttgccgtaaatgggtatcgcgcatcgttaggtggatctgatctaataagtattcaaatagtgaccgctgattagaggtcgagacacgctcgataaaatcagcctttgatgtcacatttttggctgcattcaaactcgcatgattattattccaatttgtatccacatcaatcaacgggttctctaatgccttttgcgtcagaaagtctcgtaattcttccacattaaactgcaacatctgaatggactgttgtagtcgctgggtcattgctaatttctgtgattgccgctgttgctggcgaaatcctggtcccagtgccataaaaatacctccctgaataaatttttatgtaaaacccttgtgtttttatccattattcgctagaatataatatgttgtttaggcgcccgtagtgtaatggatcgcacgtaagattccggttcttgaaatgggggttcgattccctccgggcgcatcagtagctgagaaatgattctcagctttttttgtacgctcatttaactggttgtcactggactataccagtcacatcttcatatggtaacttaatttaaaccaaacaacaagcaatatccttctggcgtcagtcccagtgctgccgccccttcactccgagtacgatcgatcaaaagtagtcagctcaagtaagccatataccagtgtagccgtttagcagatttaataacagctaaacatactattatttcaataataatcgcaacaagcctattatattatagaattagtttaatcatgaacaatccgtccatgcgtatcatcctgattaattcgccagcacgcggcaccgaaaatatcaacagttaccagcttcgatccagtccaaaaggtcaacctactgtcagtccttctggtacacacgtcgataccagctaacaggtaaatcgcaacgtttaatcacttcagtatcatctgccatcatcagtaatcttgtcatgcaccggtcagcacgccaatgagtgggcgccaatcaacgaggcgcatattagcagacgtgttcgctaatgtcctataattccaaattagtcattgaacgattagccttaattcattattatagaagaacgttgttttcgaaccaagcaagatgcaacgttaaattcaaggaacaggaactcaatcgccgaaaaaaaagagattgggttcacccaatctcaagccgtatatgatagaaacctaagtataccacgttaacaacataaacggaattttgtttttgaggtttttcttttgaccttcactgaccttagcggtaaactacacttatattagcaatcagctaatcaaatattgcaaccttaggaggctaacaaatcatgtatccagttcctacagttattgaacagtcatcacgtggcgaacgcgcttatgacatctattcacgactattaaaggaccgtatcattatgttatccggtcccattgaagataacatggcgaacgctattatcgcccaactactcttcttggatgcccaagattcaggtaaggacatctatctttatatcaactcaccaggtggtgtcgttactgccggcttagcaatctacgatacgatgaacttcatcaaatctgatgttcaaaccatcgttatggggatggcagcttccatggccagcgtcttagcttcatctggtactaagggcaagcggtttgctttacctaattccgaaatcttgattcaccaaccatccggtggtgctcaaggtcaacaaacggaaatcgaaattgttgccgaagaaatcttgaagactcgtaagaagatcaaccagattttagctgacaactctggtcaatccgttgaaaagttgaaccatgatactgaacgtgataactacttaagcgcacaagaagctaaagactacggtttgatcgatgatattatggaaaacaacaaattaaaataagctaatccttttagactgggctaacacaacgttggcccagttttttttggttcattttcttgtcattcgtttttcattagcccatactgcacttaaagtaaccattatcacgcgggcaatactactgccctcaatttacatgcacaaaggagttgccattcatgacaaaagtttttattgctggtcaactgccagctcaagccaacacgttattgttacagagtcagctcaccatcgacacctataccggcgatgacttgatcagtcacgccgaactcatccgccgcgttgccgatgccgactatttgatcaccccactctcaactcaggtcgatcaagacgtcttcgaccacgccccacaccttaaactgattgctaattttggtgccggtactaataacattgacctcgcagcagcggcgcagcgccatattccggtgacaaacacgccgaacgtttcggcggtcgcaaccgctgaatcaacggttggcctgattattagcttggcgcatcgaattgtggaaggcgatcacttaatgcgaactagcggctttaacggttgggcgccactgttctttctcggccacaacttacaaggcaagacactcggcatcttaggccttggccaaattggtcaagccgttgccaaacgattacacgcttttgacatgcccatcttatacagccaacaccaccgcctaccgattagccgtgaaacgcaacttggcgcaacctttgtctcccaagatgaccttttgcagcgcgccgacatcgtcagtttgcacctgccacttaccgcacaaacgacccacctaatcgatagcgttgctttcagcaaaatgaaatcaacggcgctcctcatcaacgccgcgcggggaccaatcgttgatgagcaagcactggtggcggccctacaacaacatcaaattgccggcgccgcccttgacgtctacgaacatgagccacaagttacgcctggcttggccacgatgaacaacgtcattttgacacctcatcttggcaacgcgaccgttgaagcccgcgacggcatggccaccatcgttgcggaaaacgtgattgcgatggcccaacaccgaccagtcaagtacgtggtcaacgacgtcacacctctataggccaatcaagacagccgcttggtgtaacgacttggacatggcaacaccatttcttgaaataaataagcggtccaccccaactcatcaaaacactttgacaagtcggaatgaaccgcttattttgttctagttgcgtcagcacgttgacttagtgtgcctgttaagccaacaacggcaccactaacaaacgcttcgttctctcaatcagttaattatttggcaatataagcatacttataattccactgtgtcccagcagtattatgaataataccctttacctttggattttgtaaataagagtataccgtctgatacaatggcgtaattccttggtccttcatgatcgtcttctcagcgttgatcatatcttgccaacgagcactagtatcattggcatcctggttttgagccttgctaaccaacgcattgtaagtgctgctgttatatttcccgtaattataaccactattattagtcataatttgcaagtgcgagattggatcattgaagtcagcgccccacccactgagataaaggtcaaagtcaccactttgagcacgactcgaagcaacctttgatggaatgttggacaagttgaccgtcagaccatcgagattcttttctagggctgatttcaagtattgggaaattggcttattaggctcatcattagaagctaataacttaaccgataacttcttgattcccgtttccttaaggccttgtttccataacttttgtgccagcgctttgttatatgacgttgaattcttaaccgtcgattcgtccgcaaaatccttgccagtcttagcgtccttaactaaatcctgcggaacaaatgtctttgagactgtcgatgcgtcaccaattacattcttcactaacgtcttacggttgatcgacaatgaaattgcttggcgaatcttagcgttattaagcgcctttttgatcgtcgcgttgctgtcttggaaattataaactaggaacgcggtgatggaataaggatacgtggtgtagtcagaactactcttcatgttcttaacctgttcactcgccagctgcgttaaatcaagtttcttttcttggaacaagttcaaggtcgtcgtggtgctttcgttaaccgtataattgatctttttcagatgtacggcttgcttatcccagtactgattattttttacaaactgccaactattattagtcccagtccagccggtcaacttaaatgggccgctgtaaagcatgtactgagccttagtggcatatttgctaccccactttttgactgctttttcactaattggtccaaataatgggtaggtcattaacttcttaaagtaagtaattggcttatcaagggttacgataaaagtatgctggccctgtgccttgacgcccaacgtacttggcgacttcttcccggcaacgatttcgtccgcattttttacccctgagaagaggtaggcatactgtgacttagttgctggcgtaacggtccgtttccacgaatagacaaagtcttgcgcagttatcttcgaaccatcactccacttcgcattgcgaatcgtaaaggtatacgtcttgccatcctttgaaaccttagtggacttagctaatcccggtgtaatactcccatttttccctaaccggtataaactttcgaaaatgttacccgtactgccgtatcccgacatattagaaatatcgattgaatccaatgaactagggtacgacaagtttaaaacttgactactggcatacttgccattacccgaagactggttactttgcttcccacacgccgccagcaccgtcactaatactaggctcattactactgctaacactgatcgcttcttcaaacttctcgcccctttacattcccattttgatgtattgattgccttattcccaccggtggtaacaaaaaacgcctgtttagaatctcgtcagattccaagcaggcgtttcaaaattaacgatttgagctcaatcccgttatttttgatgcagagacgcttgtaattcaacgcaaatagccatgttgtttgattcacaacatgggcagcacatcatcatttgcattgctgatttttgcataattacgtctctccgatttcaataagatgtgttcagtataaatagttgcacttacttttgtcaagtgtttttcgaacgcgcctaacgacaactcagccatttcaacaaaaaaagccgctagcaccatcgaaaatgctaaggagcttttcatgcttagaccgtctttatccagacctaagcgtctttttgtaattgttccgcaaattgattgattttacgcagccgatgattgattccagacttagaaataggcccgcccggaacaagggttcctagttccttgaggctaacttcacgatgttccaaccgggcaacagcgacttcttgtaattttggtggtaactgttgtaatcccaccgtagcatcgatcaataaaatattttcaatctgtttgctagaggcattggcaaccttatccatgttggcattctcacagttaaccaaccgattgaccgagttacgcatgtcccgcatgattcgaatatcttcaaacttaagcatggcattggtcgcaccaaccaacgacaagaagtcggcaattttttccgcttccttgatgtacgtaatgaaaccaccacgccgatcagtcgttcgtgaattcaagccatactgattcatcatctcggagatcatatgattatgttcctcatacagtgagtaaatttccaaatgataccgggaagtttcaggattattaaccgaaccgcccgctaaaaaggcgccacgcaaataagaacgcaccgcagcatcatccgttaacacttcagttggtgccacttcaacgatttgataatcctttaaaatacccaaatcagcgagtaccatgtccgtaccggtcttcaatcgtacgatgtacaaattattcttatttaatttcattttgcgccgaacaatcaattcactatcgacgtcataaaattgtttgagtagccggtaaatacgccgcgcgatggccggattttccgtctgaatattcaaaatgaagtgatgattagcaatgctgatcgccccattcattcgaatcaaagccattaattcagccttagcattctcgcgatggacagcgaggttagtcaattctttcttaacgtcactggcgtatgacatgccacgacccccttatctgaaaacgtcggaatgaccgactagattcattaattcagcgacaacttggtcgccatcatgaaaggccccattatcgcggagtttcaagaagttcgatgagattacgcgacagttttgttcacgtaaccctcggaagtcatgactcacttgctttgaaacttcgttaaacttatgaaaatccatgtaatcttcgggtactttttcagtattcactaatactgtattaataaagttttggcctaaatggcggttcaagactcgcacgtgatccgcgtcagagaaattatcagtttcccctttttgggtcatgatgttacagatgtagaccacttccgcatccgactcacagacggcctgaccgatattactaatggtcaggttaggcagaatgctggtaaacaagctcccaggtcctaagacaatctggtcagccgccataatggcatcaataaccggttgcactgcttgcggttccttaccgttcttgtcagtgacccacacgcgttccaaagacttatgggccgcggtaatttcggcttcacctactaactcagtaccgtcactaaacttaccatgtagcgtgagtgcctcgttggctgccgggtaaacatgaccatctacttgcatcatatttgataattcctgcaccgcgtcaaacaccccggatttcatttccgttagtgccgcaataattaaattaccaatcgcatgacctgcaaaaaattgatcatcaccctggaaacgatactgaaaaatatctttatacaaatccggccaactcgacaacgccaccattacattacgaatatcaccaggtggaaccacgttaacgtaattgcgaataatgccggatgacccaccatcatcagccaccgtcaccactgcggtaatatcgactgcctgcttacgcaagccgttcagaacaaccggcaaaccggttcctccaccaatcaccacaattttaggccgctgggtcttaaatgtgtattttctcatgagcgattaacagtttcctttcgtttctcaatatcacgatgactgatgtgcaccttgtagtgcttagccagcgcttcaccgatacgttgcgtcaaggcaacggaccggtgttgaccgcccgtacagccaatcgcaatcgtcaaactactcttgccctcggcttcatagccgggcataatgctttccagcatactcaagaactgctggtagaaagcttccgtagctggttgctgcataacgtaatccgccacaggtttatctagtcccgtcagcttctttaattcaggaatgtagtatggattaggcaagaagcgcacatccataacgatatctgcatcaatcgggagtccgtatttaaaaccgaatgatagcatttcaatatgaaaagtctcatcctgatccgtttcgaatttatcaaaaatcgattcgcgtaattcacgtggtgtcaacgtcgacgtatcaatgacgtatgaagcccgatctttcaatggcgccaataattctcgttctttgcgcacgccatccatgacgcgaccttccatggctaatggatgggaacgccgcgtctctttataacgtgacactaattcttcgttggaagcatctaaaaacagaatccgggtcgacacaaagtccgtgttgtctaagttagccaacatatccataatttcgtcgtaaaaagcccgcgagcgtaaatcaatcactaacgctactttctttattttacccgactcctcaactaattctgagaacttcggtaataacgctggtggcatattgtcaatgcaaaaatagcccaggtcttcaaagctttgaaccgcaaccgtcttaccggcaccgctcatcccagaaataattactagttgtaatgattctgccatgctgtattggcctcctctagtccatattgttggtagtataacacaccgggtgtgtcatttctactggcgggccgctgtcacccgccatttgggtaaaattacccgttaattaatgcgcaaaaaaagacccggtaaccacacaccgacaccgctaataacgagcgtcaggtatcgctaatgggtcaatactgccaagctagttacggcgcgcaaaggcaatcaaaattgcgttgatgccaaaaactgcgaagtagaaactaaccaggacgttgaaactaatcacagcaatcattggattgattactaataagattcccaatgccaaactaataatatccaagattaaagatagaacaaaatacccggttccaaagacgcgtagatgtgagaccacggtcagccgttcaatcgaatcgatcaagaaccaaaaggcaaagacgtaaccgagtaccagtaccccagtcggtgcgtggaataagaatagtaatcccactaaaatatcaataatcgcaaacacaagggcaaagtttgcccgcaaccctgtttcacggcgtagtttggtgtacccaccgatcgtggtgatcccgctaataattgcggcgatggcaaataaaaagactaaacttaaaagtgctgcttgtggttgcttgatgacaaagtaagcggcgatcaagaaaacgattcccgtcatgaattccgtccaatcaaacccccagcgatgatcattaaacatacatcaacatctcccatatccggtattaattccatcttaccagttaatgtaagagtttccaatttttctgatagactttatgttagcttaatgctttttcaaaatgtcgatagcactaaaaacgaccttgaagtaccggtgagccgccacttcaaggtcgttttcgaaaacaatatcaatggtcaaattgataaacattaattaatcggtggttcctgattgataggtcgctaattgcgcttgtgcccgttgcaattcttttctgatctgatcaaaacccgtaccaccaagcgaatgccgccgctctaccgcaactttggcgtccaaatcgtgatagacatcttcttgaatcagcggtgaaatagcctgatactcactgagtggaatatcctgcaacggccgctgctttttcaagccgtccaagacgagcttaccgacaatggcatgggcctcgcggaatggaattcccttattcgccaggtaatcagccagttcagttgcatttgagaaatcgttagtcgtggcatcagccatgcgatcttcattaacggttagtgttgccaacatgccggtgaagacgtgaaggctcgtcaacacggtcgtgaccgtatcgaacgccccttccttatcttcttgcagatccttattgtaagcgagcggaattcctttcataacagtcagtaatcccatcaagttaccatagacccgtcccgacttgccccgaattaattcagccatgtcagggttcttcttttgcggcataatcgaactacccgttgagaactgatcgctcaaactgatgtacttgaattcgtagctactccagctaacgatttcttcacaaaaccgtgagaggtgcatcatcaggattgacgcgttactgagaaattccagcacgaagtcccggtcagaaacggcatccaaactattatgatagacttcactgaatcctaatagtttcgcactatattcccggtcgattgggaaagtcgttccagcaagtgcagcggctcccaatggcgaaatatcggtatgcttcaagttgaactcgaagcgttccatgtcccgcttgaacatttggtaataagctaacaggtagtgcgcgtacgagatgggttgggcgtgttgcaaatgcgtgtaccccggcatgaccgtctccacgttctcactcgctttatcgaccaataccgtttccagttcatgtagccggtccaatattagtggtaattgatgtttcaagtataagtgaaaatccgtggcaacctggtcattccgcgaccgggccgtgtgcaacttaccagcgaccggcccgatctcttcagtcaataacgactcaatattcatatgaatatcttcgttgaccgttgagaattccaacttaccctgtttttgacgttcagccaatgtttccaaaccagcaacaatttgatcaacgtcggcggcgggcaaaataccagttttcttcaacattttagcgtgtgccagtgaaccagcaatatcttctgcggcaagcaactggtcaaagttaattgacgccccaaagtcatcaacatacttcgcacccgtttcggtaaaccggccaccccatagcttcttggtactcattaggcgtgcgccttatcagccttagccttagcttcggcctgagccttcgcttggacctgggcattaacttgggttggtaagccccataacttaatgaaaccaactgccgcttgttggtcaaaggagtccgctgacgtataggttgccaagttcgtatcatacagtgagtttggtgactttcgcccttcagtaatcacgttacccttgaagagttgtacccgaaccacgccattaacaacttgctgagtctgcttcaagaaggccaccattgcttccatcagtggtgagaaccagaggccgttgtagatcgtatctgcaagcttctgttcaatgattggcttgaagtgggctaactcacgctcaaacgtcaaatcttccaaatctttatgtgctttgagcaataccgttgcagctggtgcttcgtaaacttcccgtgacttgataccgaccaaccggttttcaatatggtcgatccgaccaattccatgttcaccagcaatctgatccaacttgatgattaaatcagctaggttaagtgattcaccatctaaagcaactggcaccccagcttcaaaagtgatttccaaagtcgttggcgtatccggcgtatcagctaaggccttcgtgcggtcaaacgcatcggcgggcgcaccctgccatggatcttctagaatcccacattcattggcgcggccccataagttttcgtcaatcgagtaagggctgtccagattgattggtacgggaatattgtgtttcttagcgtagtcgatttcttcttcccgtgaccagtgccagtcacgtacaggggcttcaatcttgatgtctggtgcaagggcgtgtatggcaacttcaaaccgaacctgatcattacccttcccagtacaaccatgggcaatggctacggcgtgctcttgcttcgctaaggtgactaacttcttcgcaattaaaggacgtgaaagtgctgaaactaacgggtattcaccttcatacaaagtatgaccttgtaacgcaattaacgcgtattcttcagcgaattcctgcttagcgtcaatcatgtatgatgaaacggcacctaatttcagggccttttctttgattgcatccatgtctttgccttcaccaacatcgattccgcaggccacaacatcgtagcccttatccttcaaccaactaattgcgactgacgtatctaaaccaccagaataagcgagaataattttatcattttgtttgaccattgatttgtacctccgaaattttttaacattgcttttctcaatgacagtatcgtaccacctgatttaactttatgcaataatattttaaatatattcaccatttacgtagcattcactggattatagaatatttatacatatattcactgataccggtatattttttgttatttttagactgtgcttcgtctcaaccttaactcggccactggtactcatcggcctttttcaaatgtgctaatcccagccaccacgcgctgagcaacagcacgacctaactcaagcaggcaacaacgataccgcactacttgtcgctgaacagcaaaaaagagcctagccctccatgacggaaagttaagctctttttgcttggtggcagtcaccaccattagtttttatcgttcagactattcaacgactttgcgtacaaatgggtcggatgagatcccctgtgataagatcaacttggcccattccttagctgagaataaagaatgatccttgtaattcccacagctatcgatggtcgtcccttgtacgtcttcccacttagctgggccagcaatgaattctaatgaggacttcaatgccttagcaacttcaacggtgtcatgttcaccccaagtaatcaaatgaaaaccagtccgacaaccaaatggtgagcagtcaatcacgccatccatacgatcacgtaataacccagccaacatatgttcaatcgtgtgtaagcccgccgtatcaatagcggtcttgttaggttgaactaaccgcaaatcaaaattagtgatggcatcacccttaggcccattttccaccgtaattttacgaacgtaaggtgctaaaaccttggtatgatctaatgtaaaactttctactttagccatgtacaaacaactcctctaaattaaaattacattacaaactcaagtgtagcacattgcccgttatttagcaggtgcagttgcttcacgtgctcgatcccgttctagaacgggcttcaagtattggccagtataactttcagccacttcagcgacctgttctggtgtcccagtagcaacgattgttccgccgccgtcaccgccttctgggcccaagtcaatcaaataatccgccgacttcacaacatccaaattatgctcgatgattaacacggtattacccgcatccaccaaccgatccaagacaccaatcaagcgccgaatatcttcactgtgcaacccagtcgttggttcgtccaagatgtagaaattcttccccgactgttgtttgtgcaattcggaagctaacttcatccgttgggcttctccacctgataaagtcgtggcgggttggcctaacttaacatagcccaaaccaacgtcgaccaaggtctgtagtttccgtcgaatctttggaattggttcaaagaacttaacagcttctgaagcggtcatttgaagaacatcggcaatatttttgcctttgtattcaacttccaacgtttcagaattgtattgcttaccatgacacacttcacaaggtacaaagacatcgggcaagaaattcatttcaatttttagaatcccgtcaccgtgacaagcctcacaacgaccacccttagtattaaaactaaagcggcccttcttgtaaccacgtaatttagcttcattcgtttgtgcaaataaatcacgaatattgtcaaagacaccagtatatgtggccggattactgcgtggtgttcggccgattggactttggtcaatattaactaaccgttcaatattcttaataccactgacactcttatacttaccaggcttttcagaattacgattcaacttctgtgccaatacgcgtttcaaaacatcgttaaccaaggtcgacttaccagaaccggaaacccccgttaccacgacaaattcgcctagtggaaaatcaacgtcaatttgcttgaggttgttttcggccgcaccagtgatacgaatcttcttaccattacccggacgccgagtttcaggtagtgggataaaccgtttgcccgatagatattggccggtcagtgacttccgcgagcgagccacttgcttgggcgttccggccgccatgacctcaccaccgttttcaccggcacccgggccgatatccacgatatagtcagcggcccgcatcgtgtcttcatcatgttcgaccacgatcaacgtattccccagatcgcgcatcttcttaagtgaaccaatcaagcggtcgttatcccgctgatgcaatccaattgatggttcatccaagatatagagcacgccggacaagttcgatccgatctgtgttgctaaccggattcgctgggcttccccaccagacagcgtccgtgcagaacggctgagcgttaagtacgccagtcccacattttgcaagaatgataaccggtcgcggatttccttcaagattggtttagcaatcacgagactttgttctgataagctcaactcgttaaagaaatcgagttccttaccaatggctaagtcagagaccatcccgatatgttcgccaccaactttgacagacagggccttgcgatttaagcggaacccatgacaagtctgacaagtgagttccgtcatatactttcgcatcacatcgcgggtgaaatcactattcgtttcgtggtagcggcggtcaacattgttgataacgccctcaaacacagcgtcaacatcgcgaacaccaccaaagtcgttctggtagtggaaatggaacgtctttccgttagacccatacaaaaccgtttgttgatcagcttttgataagtcttcatacggcacatccatcggaatttctaactgttcacaagcttgcttcaacatttcaggataatactgtgaactgattggattccaaggcgctaacgcaccttcagccaacgtcagcgacttatcaggaacgacaaggtcctcatcgacttctagtttgataccgaggccttcacagtccggacaagcgccctggggtgcattaaacgagaatagccgtggttcaagttcccccacagtaaacccacagataggacaagcgtaatgttctgagaacatgatgggttcgccaccgatcacatccgcaatcgcatagccgccgcttaatcgcaatgccgcttcaaaagaatcaaacaaccgcgaacggtcaccggacttcacaacgattcgatcaatgacgatttcaatcgtgtgttgttgattcttgttcagttcaaaagtttcactgatatcatgaatatcaccatcaacacggacccgcacaaagccttcacgcttgatcttttcaaagatttttttgtgctcgccctttttctggcggacaattggtgataaaatctgcaacttggttcgttctggcaatttttgaatccggtcaaccatctgttcaacggtctgactcgcaatcggtgtcccgtcatttggacaaattggttcaccgactcgggcccacagtaaccgtaagtagtcattgatttccgtaacggttccgacggtcgagcgcgggttcttggaagtcgttttttggtcgattgaaatggccggactcagcccgtcaatcgaatcaacgtctggtttttgcatctgtcctaagaattgacgtgcgtacgcagatagactttcgacgtaacgccgttgtccttccgcatatagggtatcaaacgccaacgaactcttgccagagccagataaccccgtaatcacgactaatttgtcacggggaatagtgacgtcgatatcctttaaattatgggctcgcgcaccgtgaatgacaatcttatcatttgccaaaaaaaggcctcctcaatctcaagccagcaacctgctagctaatttgtgctttcaattccatgaccgtatcacgcagcgttgcggcttgttcaaagtcgagcttcttagcggcggtcttcatctgttcttccaacttactaatcatatctaattgttgttcccgggtcatatcatcaaagtcggtttctaagaagtcatccttcttgcccgcgtcttcagtggccttcgtcgaagcaattaactctggaatggccttcttaatcgtgtgtggcgtgatatgatgatcttcattgtacttcatctgtaccgcccgacgacgcgcagtttcatccatcgcagcctgcatcgaatcagtcgtggtgtccgcgtacataatgactgaaccgtgctcattacgagccgcccgaccaatcgtttggatcaatgaacgctcgttacggaggaacccttccttatctgcatccaaaatcgcaactagtgaaacttcgggaacgtcaatgccttcccgcaacaagttgattccgaccaacacatcgaacttgcccaaacgcaggtcgcggataatctgcgttcgttccaacgtcttaatatcactgtgcaagtaccgtaccttgatgcctaaatccttaaagtagtcggtcaaatcttccgccatcttcttagtcaacgtggtgataaagaccctttcgttgacttcaatacgcttattgatttcacccactaggtcatcgatctgacccataatcggtcgaacctcgatcgttggatccaataaaccagtcggccgaataatttgttggacgacgtgcttggtccggtccatttcgtacgggcccggcgtcgccgacatgtaaacgacttgattaatatgctgttcaacttcttcaagtttcaatggccggttgtccaacgcacttggcagacggaagccataatcgactagcatttgtttacgtgcccggtcaccattatacatcccccgaacttggggcatcgtcacgtgtgattcatcgaccacgagcaaaaagtccttcgggaagaagtccagtaacgtatacggcggttcgccaggtttacggccatccataaaacgtgaatagttttcgataccactagtgtagcccatttctttgagcatttcgacatcataagtcgtccgctgcttgagtcgttgcgcctctaacaatttgccatcggccgtcaattctttcagccggtcatccaactcatcttcaatacccttgatggcgtgttccataatcgcatcattcgtcataaagtgggtcgctgggaagattgcgacgtgttcgcggtcggccacaatctcaccagtcaacgcgtcgatttcgcgaatgcgatcgatctcatcaccaaagaattcaacgcgcaatgcgtggtcgtcccgtgacgctggaaagatttctacgacatcaccatggacccggaaacgcccccgctggaaatcaatatcattacgatcaaattgaatatcaacaagtttacgtaacagatcattgcggtcgatctccatgccgacccgtagcgagaccacgtgatctttgtattcgtgaggatcccctaaaccgaaaatactggagaccgatgccacgacgatcacatcgttgcgttccaataatgagctggtcgcagagtgccgtaacttatcgatttcatcgttgattgccgagtccttttcgatataagtatcactcgaaggcacgtacgcttccggttgataataatcgtaataactcacaaagtattcaacggcgttgttcgggaaaaacttcttaaactctccgtatagttgtcccgctaacgtcttgttatgtgacaagatcaacgtcggcttatttacttttgcaatcacgttcgaaatcgtaaaggtcttcccggtcccggtcgctcccaacaagatctgctctttttcgcccgattcaatgccagcagttaattgctggattgcctggggttgatcgcccgttggttggtaatctgaaactaagtcaaaatgattattatctacccgatcaatcaaacgtagtcctccctttgaacggtcacccgtccatatcatctattgataacaaaaccttactgtcgcaccataaaaaataggcaagcccgcgcttccctatcagattcaaatcgcatttaattttagcacatcgaacatactttcgccattaatcagattgcggttcggccgttaaaattcgggtcgtcaacgcctgtaattgatcctgatgcgtgaacggttccgctaacatctctggtagcaccgactttaagaaatattgaacactagtcatcttcttaaaggcgacaattgtttttaagctctcttgataaatatccgtaaaaactggttccggattacccttttgaatttcaccaaatgactcgtacagtaggtcaattttatcagctaccgacagaatttgtccctctaacgtttcatctttgccttctgataagcgccgtgaatacgctgcctggaattcagccgggatctcattttgcacaaagttttgtgataacttatgttcaacgtccgccaacatcgtccgcagtgttggcgtggcgtacttgacaggcgtcttaatatccccgataaaccgctcattatagtcgtgattcaatgctttctcgtaaagtgcgcgccaatccacagtctgtccggcattttcttccacgtcacctagaaattgggcgacttcggccactttgaatgagtgcgccgcaaccgagtgattctgatacttgaaaaaccccggagcccgttgaatcgtttctaaattacttaagctctgaaaatattgatgcattcccattgcagccaccgtccttcaatctaatttggcctaagtgtaacaaaagcgccccggggacgcaaacccggagcgctgtcgttgattagcttaactgttatgcaatgttaaacttgctgatgtgaatgaacctggttcggtaatcgtaacataaacgccattaaataagaaacaatcaagaatccggccaccgccagatatggatagtgataattcatatctagtaacatccctgacatgattgggccaacgatattgccaacactcgttaaggacatgttaagcccattgattagcccctggttggcctcacttgctttcgttaatagggtcgtaatcgcaggccgcaaaagatcgaatgccgaaaaaataacgagcgttgcaaccatgacagcaactttcgaatgagcctgcgtaatccagatagtgcatagcgccgcagctgcaaagcacacccgaatgacccgccgttcgccccaacgctggacaaaggtatcaaatagtgccacctgtaggaagagcgaaatcaaaccatttaaagtcaagaccaacgcaatgttgctcagactaaagtgaaagacttcattcacgtaaatactataaatgctctcaaacccctgtaagccaaaggaagacaccaaaatcatcgtaaataatataataatcgggacggtccagaacgcccgcgtcatcgggtggtgggccgtcgttgtcgcggctgtgattgcctcgcgatcaggatcaatttgacgatcggcaggcaagagaataacgagcacgatcgcactgagtagtcccaatgcaccagcgacccaaaacggcgtcttgtaactgataccagctaacaccccaccgatacctgggccgagaatcaagccaccactaaaggccgccgatagccagccaatcactttcgcccgctgccgtttggtcgtaatatcggacgctaacgccatcgccgtcggaacgaccatcgctgctgatagcccaccaacgatccgggaaatattaaagacccagagctggttggttagcgcaaagagcacttccgagaccatgtataagagcagaccgaccgtcaatacgggcttgcgaccaattttgtctgaaacccgaccaatgattggtgaggccacaaactgtgccaatgcgaataacgcattcattattcccatatcagtggcagttagatgcagttcatttttaataaacggcatgaccggaatcactaaactaatccctaaacagactaaaaactcactaaaaactaaaattaatattgcgcgtcgtgtttgtcgatccatgcgacctcacctcttcaatcaattcttaaatttgcaccgctttccatcatatcagggactcgaattgaaagctagcagaaagtttggcaccatttgcaacccttttagtcggtaaaatatcggccaatcagatacaataagcataactaaattctaaggaggccctactatggatcaagctttaactggtttcaccaatattcaacacttagaccccgaaatcatcgttgacctgcgttatgccaccactaataactttactcatcaagtgatttacgactttaccacggccattgttcgtaccggcacagcccacaagctcgctaaggcaagcgcgctggtcaagcaacaaggttatcgactcaaagtctgggatgcttatcggcccgtcagcgcccagcgccgtttatttgaagtgtatcctgatccagaattcgtcgctcaacctaatcctaatttcagccaccaaaaaggcgtcaccttagatttgaccctggcccatcctgatggtagcgagttgaccatgccaactgccttcgatgacttcacagcagctgctcaccgtgacgctcctcgcacgacgcttcaagaacaaaattatcagttgctggactccgctatgaccgctgcgggctttgtcggctacgttaatgagtggtgggattaccgcgacagtgacatggacgactaccaccccctggccgctgatcccaacgactacgcttgactcataacgcaccactaatataaaggtgaccaccaaacatttggctcgagaacgagactgtttggtggtcacctattttactttttaaacttattgatttaccaagaagtatgaagtcagattgtcgttcatcagtacgtgtgcgtcccatttcaacctccgggactaaccggcgttttctaccaatactcagtggtggaaggtcggtatcggacgaatccaccgaaaaaggcgcgctcgtctttttcgcgggtctaaaccgtgtacacttgactttagaaacagcagccttaatgcaacagcctaattgttccgacgatagccgtgttcttgatcaactgcaacttgagcggcaaggttcaagtaattgaatggctcgtcaaagtttggtgaaaatagcatgtccatgaaggctaattcgtcaatggtattgccattttgaattacgactgatagtgtgttcgcagactgtgagacttcgtgggcactcattagttggccacctaatacttttcgcgtttgttgatcatacacgagttcgatgctgactttggtcgttgttggcataaagtcggggcgatagttgccttcgtaaaaagccgttttggcttcaaagctcgctgccttagctgcggcgagcgtcattcccgtgcaggcgacggtttggtcaaatatcagcataccagtcgttgcctgggttccaatcgagcctaaccgtttgtcaaaaatgttgatgccagccagcgcgccttgtcgaatcgcatgtgagacaagcggaatgtacgcccgatccttggtaggattgaatttaacttccgtcacatcacccgctacaaagatatcggcattggacgtccccatgtatcggtccgtcacaatcgcgccccgctcagttcggttgacttgtcccgctaatagttctgattgcggaacgaccccaggacaaataacagccatatcaaatgtttcggtagtgtcagccgtatcaactcgcagtcgattatcagcggtatcactgaaggcggtcacttgcgcgttcgtttttacggtgatgcccttagtagttagcaagtcttcaattctctgtgagagttgtggatcaagatattcattgaccaagtgcggtccacgctgaaataaggtgacggtatggccggatttcacataaccttcagcaagctcgacgccggaatatccaccaccaacgatggcaatgtgatgggccgttttagccgcttcatagagttgttgtgcttgctcacacgttttgcacagcatcactttggggttttcaacacccggaattgccggaattgctgtgatcgacccggtcgccatgatcaatttatcatagtgatccgtgtacatttctttcgtctgtaagtcctgagccataattgtatgcttatcagcatcgactttaatcacgtcataccgcatccgcatgtgcacaccctgttcgctaaattcagtcggattcgcgtacagtgcttgatccaaatccttgatggttccccctaagtgcaaataagtcccacaagacatgtatgaaatatccgcgtgtcgttcgtaaaccgtaatttcagttcccggatagtatttcaagatttgtttcatggcggcaatccccgcatgtgtacagccaataatggcaactttcattattccgaccacagctttcgttaaaaattagcttagataaagttaaacattcatttaagttgacgtatacttagagtatactgcgattcggtcaattttaaaacggttcaatcgtctaaactacaataaaggtgatggtacttatgcaaccaatttaccgctatttcgtccaaccacaactcaacttacttaacaatacggtttacggatatgaattactcatcaagcaactcacaccggacggctggcgtcttcctgaatctttcgccgcaatcagtccacaggtcacttctgatctcctgattgcaacaacaaagattcttggccttaaagttcggtactgcgctgtcaacatcagtcgagaacaattagttgatacgacggtggctaacgctattattcagagtcaggtccaactatacccagccaaattagtcgtcgaactgactgaagagcgaagccctaagagctatcccgacacaatgttgatcccacacttacgggggttcattgaacatgggatgcaaatttcacttgatgatgttggtacggggatcaacgattttaagagtattcaggagatcctaccactagcttcagaattaaaatttgcacttcaaaacttccgtagtgatattaaagatcctaaaatccagcaaaagcttcatttctggcgtgcaatcagtagtgaatacgggttgcgtttgattcttgaaggaattgaagacgccgaagacgaccaattaagtagccacttcgacatcaatttgcgccagggctactattacggcaaaccccggctattaagattaccgggcgaccccgtcgacttcgaatatcccgcaaccaattaggattgcgccgaaccacgtataaaacagtgcctcccaaaatctaaaattgattttgggaggcgctgttgacatttattcgcatgaccagtcagctactcctgacttgaccatcatcttattccttaatgaacgcttggatggcagcttcaaatttcgctaacttatcattagcttcttctaacgtgctacctaacgtcccaatgtagaacttaatctttggttccgtaccggatggccgaattgcgatccaagtaccatcatttaaatgatatttcaggacgttcgcctttggtaacgcaattggtgccgtgtgaccatccgcaaagctttccgtttgactctggaagtcttcggtcccagtgacatcgtagcccgcaaacgcggttggggcttcactccggaacttggtcatcaaagccgcaatcttatcgctaccgccaaccccgtcaaattcttcagacgtggtttgttcgcggaagtaaccatattccttgaacaagtcttgtaagccgtcatagaggttcttaccttgttgcttatagtaagctgctacttcggctaagagtaccgtggtttggatggcatccttgtcatgcacgaatggcttgatcaagtaaccgtagctttcttcaaacccaaacatataggtatgttcgcccgtggcttcaaaatgttcgatttgttccgcaatatacttgaacccggtcaagacgttgatcatcgtaacgccatacgaagccgcaactttggtggcaaattcacttgagacaatcgacttaactgcggctgcattggctggtaacgtcccagcgtccttgtttgcttgcagaatgtagtgtaacaagacagcggcgatttgattacccgttaacaagacgtattcgccattcggttgacgaacagccgtccctaaccggtcagcatctgggtcgaccgcgatcaagacatccgcgccttcctttttgcccaaatcgatggccatcttaaaggcttcaggaaattcaggatttgggaacttgaccgttgagaattcagggtcagccacagcttgttccttaacaacactgaagttcttgaacccggcattcttcaaggccttttcaccgagcatccgaccagtcccgtgtaatggtgtgaagactaacttcatgtccttaccgacttcgtccactaacttttgattgattgtcacttctttgaccttagccaagtagtcctgatcgacgtcgtccccaataatggtttccgtcttatcagctaataattgttgttcatcagcgacggcaatcgcaaagacatcatccactttacgaatgtatgaggtgatgaggtctgattccttaggtggcatctgaccaccatcttcgccataaatcttgtagccgttatattgctttggattatgactggctgtaatcatgatcccagcgtaagtatgcaagtgtcgaacggtaaatgagagttctggggttggccgcaaactttcaaagacgtaagacttgataccatgttggcccaaaacgcgagcagattcatgtgcgaaatcttctgagtgatgacgagaatcaaagctaatcgccaccccgcgttccttaacgtcagccggtaaggtatccatgaagcgtgctaacccttcagtcgcttggcgaaccgtataaatattcatccggttgataccaggtccgagcaccccacgcattcccgcggtcccgaattccattggttcataaaaggcgtcttctaaggcggcgtcatcgccagccatgcccgtcaattcttgttttaaacttgtttcaagtgtcgcttggtttttccaggtattataagtatcctgccaactcacaaaaaccatctccaattccgatatttgttagtgcttacaaaaatagtatacaacattggcgcgctttacaaagtaaaatttactaagaaaatccattaattagtgcattttcaagcgtcgccggcgctaagtcccttaaattctgaagtgtcagttagttcagctactatcaaaacttgctataataaatcttataaggaggccatcatgactttttattcatacaactacttggtccaccaaaacaacaatcataccctcgttcagctcgctgccatcggtatcattatattaataatcgctgtactcagttggttatggtaccgccataaaacggacctgaaataccgcgatttattcattatcatggttttgttattattgctactcgttggtattcaatttaatgaatggcagaccattcaaaatagcttcaaccagaaatcacaagtcacgcagattatgcagcgcatcgccaaagagaaaggtgttcgcaaaaccgcggtctggtctaatacgagttctgttagcagcgggatgctcgttaaagttcacgaccagatctataacgtgacggtcaataccgatgggaatagttataccctgactaaagccacaccgattcagtcgacgatcaattatgtgaaggaggggcaataaatgttctcatactgggatgtgacgatcaaactggcccttgggctattgaccatcattctacaaatcaatctatctggtaaaagtaacctggcaccaatcagcgccctcgaccaagttcaaaactacgtcctcggtgcgatcgttgggggcatgatttatagtaccagcgttaccgtcttacaatatatattagtgctcctgatttggacactactcgtactagtcttgcgcttcctaacgcatcacaatcgctacgtcaaacgtttgattgatggacaaccacagctattgattaagaatggcgaattgcttgtcagcactgccctcaaaaatgggatgagcgctaacgacctgatgtttcgactacggacagagggtatcacggacatccgttacgtcaaacgggccgtacttgaacaaaacggccaactgacgatcactcaagtgggcgacgatgccgtcaagtatccaataatcgtcgatggccaggtcaacctcgatgcacttgaaaccagcaatcatgatgaagcctggttactgacccaattgcaggctaagcattatactgtcagtgagatttacctggcaacgtatactaacaagcaattacttctatttccataccaacactaattcgcgagctttggctcatcatcaaatagtgactaacgctatgtttaccaataaaaaatgtgtggctgattcaattgggatcagccacacattttttaaattcatttaattgttaaccttgtcgcctaaagcagtgatataagtgtaaacgccttgaccggcagttccaccttcaccaactgcggttgcaacttggcgtaaatctttcttacgaacatcgccaactgcaaaaataccagggaccctggtttccatgtgatcattcgtttcgatccagccgttttcgtcggtaatcccaagattactgaatggcttcgtaattgggttgataccaacatagataaagacaccatcgaccgcaatctcactatcttcaccagtcttgttattgttaaccttaacgcccgtaacttttttatcgtcaccaataatttcagtcacattgctgttccaaacgaattccatcttgggattagcaaaagcccggtcttgtaagatttgttgtgcccgtaattggtcacgccgatgaataacggtgaccttatcagcaagctgtgtcaggtaagtgccttcctcaatcgctgagtcaccgccaccaacgacaaccacgtgcttattacggaagaacgccccatcacaaactgcacagtatgagacaccccggccgccgtacgtatcttcgccagtaacacctaacttacgatattcagaaccagttccaatgacaagggccttagcctcaaacgtatcgctatccgtcgttacgatcttaacgtcgccacgatcttcaacggattcgacactaccatacgcgtattcagcaccgaactgggtcgctgattcatacatgtctttagccaagtccggccccaaaacggatttgaagcccggataattttcaattgcggcggtattattcatttgtccaccatagattccgcgatctaatagtagtactgatagattggcccgtgaagcatagagggcggctgtcatgccggcaggccccgcaccaataataatcacgtcgtaactctttgccatttctaaagaccccttccacttaaattactatgacgcctaatatacccccaaaatttacatttgtcgactatcttgtttgtacacaactgaagtcaattatagcttttaaccatatattgactaaaaaccgagatttaaataaataaaattatgccagttcacttgaattcaacccatggtaagacttacttcttattgtaaatccttgtcattttgcttggcccaatcgccataggccgtaattcgtgggtgattgcggcctgcctggcgttcttgttcaatcgcttgttgggcgacgaggttcagataattgaagggttcatcaaaattaggtgagaataacatatccacaaatgcgaggtcgtcgatagtgtttccattttgaatcgcgattgatagcgcattagcagattgtgccacttcatgcgcacttaagaactgagcaccgagaattttacgattttccggattataaattaattcaatcgtcagtttcgccgtacttggcatgtaagctggtcgccagttgccctcataagtcacccgttcagctggaatatgattcaatttcgccattgccagtgttaaccccgtggttgccagcgtgtgatcgaagagttgcatggccgatgtcgcttgagtccccatatatcgttgctggttaccaaaaacattggcccccgctaacgcaccctgccgaaccgcattggttgccaatggcgtataagccgaacgcccagttggattgaagttaacgacacaagaatcaccagcagcgtaaatatctgggtcagaggtctgaacgtaatcattgatgataatggcaccgtgcttatccatctcaacttgaccgcgtaacagttccgtattgggaacaaacccagttccgacaattgctaaatcagcattaaaatcgccttgattggtttcaatgacaagttcaccatcatcattaccagtaaaggcagtgacttggtgattcaatagcacgttcacgccatgatcttttaatagccgaactgcttggtctgaaatttctttactaatgtaattattcaaaatttgatcatgcgattggaataacgtgacttcatggtgcgtattggcataactttcggataattctgttccaatatagccggcgccaatgattgcaattcgctgattgtcttttgccgtctcgtaaatttcctgtgcttgactataggtcttgcataacaagaccttagactcatcgattccgaaaatcggtgggaccgcaacatttgacccagtcgtcataatcaatttatcataagtatcgccaaacacttttccagtagtcatgtcaaccacttgtaaggtcttcgactgggcgtcaatttttaacacgttatgtttggttctgaccattgcccccaacttggctaacgtttctggtgacgaatagaacatatcctccaagtgattgacctttcccccgagataaaggtaaatgccacatgataagaatgaaatgttatcatcacgttcataaatcgtgaccgttgcttccggatgatccttcagaatttgagcagccgcagcagtccccgcgtgtgtacatcctacaattacaatcttcatttcattttgctcccagttataagtttatttatttaaccataggtatattataaccgctttacttcgcaaatacataactctagtcaatataaatacaggtcatgatgaagcataactacttttaaaaaccaatcaacgatacgctggcaagcagttattctcacaatatcgtccgtaccagctttgccaagtaaccactaattaactttttactcattttcaaaaaattgccttgctcacaaagcagtttagcacaatcatcattaacccaatcgataatcgataccatgcaaaaaaagatagtgtcaaacagtttcacttattcattttttggtatagtatgtattaggaagcaccaaattgcgttaatcccagtctaaggagtccacttatgtaccgctattttattcagccccagttagataaatttaataattcactgattggttacgagatgctgattcgctatcgtgagactgatcaggaccggtggaccttaccagaaagcttcgataatattccgatcgatgtacaagtcagcttactaaaggctacggctagtgagcttgcattaaaaatcgggtcagtatcaattaactttaatcgcaagcaatttctaaatgatgatattgctgccgcagtcattgatgctcagaaaaaactattcccggttcatgttatcgtcgaagtcacagaagaacccggtgaagatacgtttacactggcggcgatgcaacaacaaattgataagtacaaggctaacggcctacaatttagcattgatgacgttggcacgggaatcaacgtttacgaccacattaaaccgttactcgaatcggccgaagaaatcaaattcgccatgcaaaactttcgggccgaagatcgtgaaaacgagattcccattcaattaaaattctggcgcgacattgcggtacaacacgatattcggttgattctagaaggtgttgaaaacgatgccgaagatcaaatggcgaatgacttaaatatttcactacgccaaggttattattatggcaagccccatttattcaaattaaaagccgaccactagatgccagcttaattagtgaatcgcaattattcagcagttaactaaaaacaaccgtgaaatctattaagatttcacggttgttttgattaatcaagtattatttagttggtttcttcgttgttttaggagcggcgctatcttctttagataacttagcaccaagatccttgatgtaagtccgcaagtcagccttaacatccggatgagttaacccgtattcgatcgtcgtcttcaagtagccaaacttgtagccaacatcgtgccgagtccccttaaattcatgggcaaagacccgctgagtcttgttcaacgtatcaatggcatccgtcaattgaatttcgtcacccttaccaggtttttggttttcaagaacatcaaaaatttctggtgttaataagtaacgaccaatgatagcaagatcactaggcgcatcttcaggtgatggcttttcaacaaagttattaacgttgtataggcccggttccttttcgctttcaggattgatgaccccatacttagaaacttcctcatgaggaaccttcataacagctaacgttgacgcatgtgtcttgtcatagctattcattaactgtttggttaacggtactttgtcttccattaaatcatcaccaagcatgacgacgaaaggttcgtcaccaacgaaagctttagccgttaaaacggcatcgcccaaaccacgtgggtgtgattgccggataaagtacaagttaatgtccgtcgtttcttgaaccagcttgagcatttcttccttgtgcttagcccgtaagttatcctctaattctgggttagaatcatagtaatcttcaatactacgcttgctcttacccgtgacgataacaatgtcttcgatccccgatttacgagcttcgtcaacaatgaactgaatcgttggcttatcaacgattggtaacatttctttaggcatcgccttagtagcaggtaaaaaacgtgttcctaatccggccgctgggataacggcttttctaacttttgacatgtgataaatcctcctaaaaatagtgaaattagtttggaaattcctactgaatctcaggtttcccctcgcgctgcatcaattgcggaatgacttccttaatgtcggcactcttatataatacatcataaattgcttcagtgatgggcatttcgatattttgttgctgagccagctcgtaagcagctttagtggacggaataccttcaataaccatgcccatggtatcaatcaccgtcttgaggtcttgaccagcacctaactcgttaccagcgcgccagttacgcgaatgaacactagttgccgtaacgattaaatcaccaacaccggataggccgatgaacgtcaacggttccgcgcccaacgcgacgccgagccggctaatttcagctaagccccgcgtcattaaggcggctttggcatcatcaccataacccaggccgtgaagtgcaccggcacccagagcaatgatattcttgagcgccgcacctagttcgacacccaccacgtcggtattcgtgtaaatgcggaaataatcattcatgaagagttgctgtactaactcagccgcagattcattggcgctagccgccgtaatcaacgtaatatcgtgacgggccacttcttcagcatgactaggacctgataagacaacgattgcttgccgtaattcggcgggaatttcttctgccaaaacttgcgatagccgcttgtgggtctcttgctcgagccccttgctggcatgcacgataatcggctgctgatgcgtcttagcaagcacggcggtcacttgttgagcgacctcgcgaattgctttggttggtacgacaaacaagattacatctgcgccatcgattgcctgtgctaaatcggaataggcagttaacgtttctgaatatttaaaatcaggaacgtatcgctcattcgtgtgttgttcatttaattccgtaacttgggccggtgaatacgaccaaagtcgcactgagtggccattttcatccaacagatttgccaggatactaccccatgagccagcacctaaaacggcaatttttttcctcattcaaataaccctctaatctacttgttttctgcgacagctttttgaccagaacccgctaaataccagcgattattcggattgtgataccgtcgccagatcattaacccaatgctaccaaagaacagtaccactgacaacgcttgtgagatccgaataacgttgaatagcatgagcgagtcagtccgcatcccttccgtaaagaagcgaccaaaggcgtaccaggcaacataggtcaagaagacatcaccctgcttataccaatgtgtgcggtgacgggtgaccatcagtaaaacgaatcctagtaagtcccacaccgactcatacaggaacgtgggctgccgatacgcaccccgaatatacatttggttgatcagccaatcaggtaagtgcagcccttgtaagaaactcagactagtcactcgaccaaaagcctcttggttcataaagttaccccaacgaccaattccttggcccataatcactgttggtgcggcaatgtccagcattagccaagttgggataaagcgtgaccggcagaataaaatgaccacaattccggccccaatcagccccccatagatggcaatcccaccatcccaaatacggatgatctcaccagggttctgacgataataggaccactgaaagatcacatagtaagttcgcgccgcaattaaagtaaacggtagtgcccataaaatcatatcgtaaatgtcatcgggccgaacaccccgtcgctgaccttcacgtactgctaacgcaactgcaatgacgacggcactagcaataatgacgccgtaccaatggacctggataggtcctaaccgcagtgcaattgggttaagtgcccctaaaacggtattcacgctactgccatctccttattacttgtgagaatcatgcacggaattcgttttgattaacttgttcaagttatcatcaaagaccttagtcgcgtcgtagcccatactctcggcccggaagttcatggccgcagcttcaataatgattgctaggttacgtccagtcttaactggaatcgagatttcaggaacttcaacatcaaagaatttccggttctgttctccatttcctagtctatcaaattgcttatcaggcgtccaattctcaaggtggacaatcaggtcaatgtcggtatcttgacgaacagccccagcaccgaagaggttcatcacatcaataatcccgattccccgaatctccaataagtgattcaggattgcgggggcttcaccgacaagcgtttgttcatcctgttgataaacatcgacccggtcatcagcaatcaaacgatgcccccgtttgactaattccagggccgtttcactcttcccaacaccggaatcaccagtaatcagcacacctaatccatagatgtcaactaataccccgtggacagattgtcgttcagctaatttaccttccaagtaattcgtcatattacttagaatccgtgatgatgtcattttcgttcctaaaatcggtacgccattttcttcaccggcttgcactaactcttccggaacgggtagccccgttgaaataacgaatgctggtgtggtcaactggcacatcttacgaaaaatcatcagtcgctcatcgtggctcatgtttttcgaataagcggtttcagttttacctagtaattgtactcgttcgcgaggatagtagttgaagtaaccggtcaacgccagccccggacgcgaaatatcgctcgttgtaatgtcttttttctctaataagtctgcgccatggtacacatccaggcgcgtatttttcaccaaatcggcaacggttacacttcctgccaagagaatccctcctaattattccactaataaaaaagtgtggcccgcgttgtccagtcgcgccattacgctaccctttcaagcggccacacttttatgactgaaaacggattattcctatcttctaatcttagcactttaaagcgctttattcaccatcaacgccgtctttcgcgaaaaagttggagacgatcacgttagcaattgacatgaggattgagacaaccatcgccataccaaaactcgaaaagccgaaattccccttaccaacgacgtaggatgtcatttgaagcataaagccgttaatgacaatactgaataaccccagtgttaataacgtaatcggtaacgacaatagtagcaaaaatggcttgatggcggcattcaaaattgcaagcacgaagctagcaattaaagccatccacacactcgcaacgtgaaagctgctctgaaagaagccggcaatcgcaataaataagatcgtattgattaaaattcgtttccaaaagcccactgtataatcactccattaatcttagtgacgcggatcatcctcttcatgaacgttatgaatctctttgcgtccatgggcttgcggtttagcctgagtaccagtactttgccgcatctgttcgaagaaacccgtattgtctggtttacttgggataattgtcattaatactaagtataccaaaacaccaaagccatgggtaaccaaggttaaaataacgtagagtactcgtagaatcgttgcattccagtttaagtattcggcaatgcccccgagaacaccggcgaaaacacgattattagatttagttaacttttgttttgtatttgatttcatcgttagacgctccttatcagtttatctaaccatatcttactaattgtaaaagccggttgcaaactagacgaccggctttaagcaattatttatgattagttacactaaattggaactttctggattcaattcgataatctcaccagtattcaagtacacgatccattccccaatattcgtcactaacgccccgatgcgcatcaagtacgttgcgacattcaggtagtccgtggaaccgatgaccgtctcagggtggcgctccatcttggagatgcccttctcattaatacgatcatacatctcgccgactttcgcgtctttggctgcgacacggcgtgcttcctgatcatcacttttgacgtaagcggccagcatttcttcgaccatcttccgcacgcgattccccatttccgataaggctgcctcaatttcgggaacgcggacattgcctttgacccgaatcgtcgcgtgggcaatgttacgagcataatcggccatccgttccaactccgagacggctttcaaaatggtgacaatttcacgcaaatcagaagtgacgggttggtataacgcaatcatctcaaatgatttctgttctagttcgacttcccgttggttgattttggcatcattatcaatgatttcctgtgcaagatcgcggtcgtggtcaataaacgctttgactgccttttcaatcgtctcgctgaccatcattcccatttcagtgaagttagcatcaatatcgtttagttcatcatcaaaaagtcgtcgcatgttttttcctcctaaccaaatcgtcctgaaatatagtcattggtttcctgtttaaccggattcatgaaaatctgcttcgtgtcgttgacctcaattaattcaccattcaggaaaaacgccgtgcgatcagaaattcgtgacgcctgttgcatgttatgcgtaacagttatgatagtgtaatcttggcgcaaattcaatagggtttcttcaatcatccgacttgaaattgggtcgagggcactcgtggcctcgtctaaaaggataatatcaggttcaacagcgaggacccgtgcgatacaaacccgttgttgttgcccaccagacaatgataacgcattggcatgcaaccgatccttgacttcatcccaaatcgcagcctgcttcaaacttttttccaccgctgcatctaagcgctctttatcgtggaccccggccaaacgcagcccgtagatgacattctcataaattgagaacggaaaggggttcggttgttgaaacaccatgccgatttcttttcgcaattggacggtatcagtcgtcggtgcataaatgttgtccccgttgaagtttacctcacccgtgatcgttacattgggaatcagatcgttcatccggttcaagcaacgtaaaaaggtggatttgccacagccagagggcccaatcaaagccgtgatgcctttatcatcaaaatcaatgttaattcctttgagggcctcttttttaccataaaacaatgataaattctcagttgttaaaattgtactcataaacggtcctcctatccaaagtttccggaaatgtagtcattcgtcagatcaacctgaggattggtaaaaatctcaccggtctctgagtattctaggactttgccaaggttaaagaacgcggtatagtcgctaattcgcgatgcttgttgcatattatgcgtcacaataatgatggtgtaattctgctttagttctaacaaggtatcttcaatttgacttgtcgatactggatccaacgcactcgctggttcatcgagcagtaaaatatctggcttgattgcaattgcccgagcaatacagagtcgctgttgctgcccaccagatagagctaacgcacttttattcaagtcatctttaacttgatcccacatcgccgcttgtcgtaaagaccgttccacaatttcatccaagtcttgtttcttgttcattccgcgctggcggagtgcaaaagcaatattctcataaattgattttgcaaatggattagggcgttgaaacaccataccaatgtgccggcgcatctcatagacatcaatatcattactgttaatatctaagccgcgatacatgatcttacccttaaccgttgcaatccggtcattcattcggtttagcgagcgcaagtaggttgactttccggaaccggacgggccaatcaacgcactaatcttataacgttcaaactgtaagtcaccctctgaaatagcctccgatttaccatagaagacgtgtaaatcctcggttgaaagcgcaatttcatggtctttaggatcaaacgtcatgatgttacgttgtgttgtcgtcattgtgttatctgccatcaaaacggcctcctctattcagcggttaagtgtttgtacaagcgtttgccaagccaacgagctaagaagttaaagagcaataccgcaataattaatacggctgaagcccccgccgaaacggctttggcgtccggcatgattccttctgagttgatcttccaaatatgaacggccaacgtttcggccggacgtagtggactgagtggactactgatatcaaacggattccagttaccaaagtccaaggcgggggcactttgccccgcggtatagattaaagctgcggcttcaccgaagatgcgcccggcactcaagacgacccccgttaaaatgcttggtaaggcggcgggaactacgatcttcgtcaccgtctcccaccgtgataagcctaacgcgtagccggcctcccgttgattatctgagatattggcgagtgcttcttcaatactccgagttagaatcggtaagttaaagacagtcagtgcaaatgcccccgaaagaattgagaagcctaacttgaactgcacaacaaagaacaagtatccgaacagcccaacaactacggatggtaacgaactcagaatttcaatggtcgtccggatgaggccggtcaccgtattttgtggcgcgtattcattcagatagatccccgcacccagtgaaatcggtaatgaaatcaataacgctaaaaatagtaagtagaaggagttgaacaactgaatgccaatcccaccacccgcttcaaaagccagggctggtgacgttaaaaaatgccacgaaattttgggtaccccttggatcaggatgtatcccaggagggcaactaagatgatgaccacaaaggctgcgacgccatacagcacgccagtggcaattttatcgatgcgtttagcgttcatggtttaatttcccctttcgaccaatgtagcgaatgactaagttaaagactaaggacatcaataacaggatcatggctaatgaccataatgcattattttgtaatgaccccatgacagtgttcccgattcccatcgtcaaaatacttgtcaaagtagcggctggtgaaacgaggttatgcggcaacaacgtcgcgttcccaatcaccatttgcaccgcgagggcttccccaaaggcacgagccattccaaacacgacggcggtcagcataccaggaatggccgcacgcaggacgactttataaattgtttgccagcgcgtcgcccctagtgctagcgatgcttcccggtaataacggggtaccgaattcagcgcatccgccgtcattgacgttacggtcggtagaatcatgacaaagaggacaaaagtcccggaaagaatcccataaccactacccccgaatgtattacgaacaaacggtacgacaacttgtagcccaataaacccatacacaacggacgggataccaactaataactccgtaactggccgaagaatcttagcaccccggcgaggtgaaatttcggtcataaaaaccgccgtcccgattgcaaacggtgtggcgatcaaggcagaaagaatcgtaatcagaaatgacccaacaatcatcggtaaagcccccacagcgggttgcccattcgttccgactgttccaggattccactgcgtcccactcaggaattgccacagattaatatgattttgaaagaaggttgccaacccccgtgatgcgacaaagtagaaaatcaaaaagacgataccgacaattagcgctagacacactaggctaatggtcttacctcgtcgttcaattttactagcgactgatttttttaataagctttctcgaattttatccatgcgctctccctcatttcataactgaaactttgccggccgcattccgctgtacttgcatgtcatggaccgaaatataacctaactgcttgactaatttttgctgaacagcggttgataaaatgtaatcaataaattttttagttaactgattggggtgcttccccgtatataaatgttcgtaagaccagatgtaccagcgattattctggacatttttttcggttggccggacactatcaacattaaccgtttggactgatttgtctaagtaagaaaaggccacatagctaattgcaccaggggtactagcaacaatcgaccgggctaatcccgaagaatcttgttcttgagaatcaacactctgattaccctttaaggcgtatcgttcaaatgttttacgcgtcccggaaccttgcgcacggttaattaacgtaatcggtaaattacgtccgccaacttcacgccaattggtgaccttgcccgtaaaaatctgaatcaattgttgctgtgttaaattggtgatacctgcttttttattaacgatgggggcaatgccaacgacggctacccggtgatcgattaacttgctcgccgtaatgcctgactgttcctcggcaaaaatatcagaattaccgattgccacggctcccgcctgtatttgactaaggcccgttccagagccaccaccctgtacattgatgaatacaccggtatggttactgctgtattgttcaccggctgcttcaaccagtggctgtaaggccgtggatccaaccgcggtaattgattcactggcactagtgcggtcacgatgtgtgtaccccaaccccactagtccaataatcgcaatcaacacgattaattggatgacccgactttttttcataactatatacctcctacccattgctcatattcaataatacaaagtttgtgtaaatgctttatatgagttttgtaaagattgtgtaaacgtcgatatatttttaattattaacggctttcagccctcaatatgaaaggacaattagaaaagtgcacaaaaaaacgattttcaaggtttacattaaccttaaaaatcgttatcaattagtattatttaatcacggcgtatccactacttagctgatgtcacgcgctgacttagtcgcacactgtcgctgacatccttcgcactacttcgtggacccactcgcaactagtggcaaggtgaccgtcatggttgttcccacgccccgttgactgacaacgtcgatcgtgccatgcatcgcgttgaccaattcctggacaatcgctaatccgagccccgtgccactcacgagttgctgggaacgcgacgggctcgcacgatagaaacgttcgaaaatgcgctgttgatcatcagcactgatgccaatccccgtatctttgacgattaatgaccacgtttgctggccgaccatcgtggcaatcgtaacgctaccatgcggtcggttatacttaatcgcattcgttaacaagtttttgatgatttgactcagtttctgtgaatcgcttgttatcgttaggtcagcatcgacttgattattgatcgttaaatgctggcgttcgattgcctgttgaaccacggccagctcctgttcaatcaacggtcgaacggccaacgggactacggtcaacatcgtcgtgttctgggcacgaatccgtgacagtgataggacatcttgaataaggtcgattaaccgctgactctcatccgcaatgatatgcaagaattggtcaagtgtcgccggatcatccttggcgccacctaacagcgtttcggtgaaccccgaaatcgccgtaatcggtgtttttaactcgtggctggcgttgctgacaaagtcgtcctgcatttgttcaatcatataaacttcggtaatatcgtacaacatcaagacaatttgaaattgtgaccgattgccttgaatataaacagtcgacgcctcaactacctgcgtgttaggtgccggtgtcagggtgatcgttgcccgttgatttttgccactagcaatcgtatcctcaatcaacttggtcaatgcatacaactgaatatccttagtataaatgtgagccaccgtattaactgagacttgtaataattcactcatcgctggattagataactgtacctggcgccggtgatcaatgaccatcacgcccacgggcaggtaccgcataatcatcattaactctttttcttgcagttccgcgcgacgcgtctgatttttctggtaactctctaactgattgactgcttgcgccaagctatagagggggtccgattgtggtaacaagatatgtggtggaaattgctgactactcatctgccgaagtttcgcttccatgcggtcaatggtgcgctgacgttcactttgttgccgccaagcaatcaagccctcaatcacggctagaactaaccacgcgccaactaaacagccgactaagtgccaggaccacttaatcggcgaaaaatgctgcaacacgaccaacacgatcaggactagtaatacattttccatgagtaacagccgtgtcgtctgttgccagcgattatgcatggtcgtcaccaacgaattcataaccaaagccccggaccgtcctgatcaaccgcggttgcttaggatccacttcaatcttttctcgtaaatgcgagatgtgaatatcgacgattcgcgtctcactagcatagtcgtagccccagacatgattcaagattgcatcccgactgaggacccggccttctcgttccacaaaatagacgagcaattcaaattcctttggtgtcaaactgatattttgcccgttccgcgcgactctgtatttgtcttgatcgatctgtaaatccccaaccagcattaccgaacgattggtagctggcatcggtgtcggtggcgtgacgggctcgtccggcgtcgtccgccgaataacagctttgatccgagcgagcacttcgcggggtgaaaacggcttagtgatgtagtcgtccgcacctaattccaaaccgaacactttatcaaactcatcatttttagccgtcacaataataatgggcgtctgaatcttttcttgccgtaactttttagtaacttccatcccatcaagtttcggcaacatcaaatctaataatatgcacgtgaatgattgggctaggcctaatgacaacgcgtccgcaccatccgtcgccgtcacaacttcgtaccccgcctgcttcaagttatatgataataacgtgacgatagctggttcgtcgtctaccactaaaatcttatccatggtcattaatcctcctgatcagtgaataacacaattcctaactcgtgtggggcgccattatagatcgccgtttcggtaataatcaattcctgttgccgattacgcactttgagatgaacatacgtcggacttttcagtagggccgtgtaaaattcggcttccgtattaactggttgccggttacattccaaaataatatctcctaaatcgatatttagtttgtccgctggcgtgtgtggtcgtagcccgatcacccgcacaccttgttcagtatcagaatatcgaaactgttggtgtcgatcatgataacgatgctgtgctaagattccccaagttagcacaacgattagtcccatcagcgttagtaaccactgcgggctgagcaccgcaaaacgggcaatgattgcaaccacaacacttgcgcacgcgacccaaccatagcggaccgctaactgccgccacgcaacttgcggtaactgcttataaacgcgaacactcgtcccaactaataaaggtaacaacaagatactgaaggaccgttcaccgaccataaacacgggccaccagctgatagttgcgtgtaaccaatcgccgggaaccagtattccaactggtaagactaacaattgttgccactggtaacgaacaagccgctttccacgttggtcgggctgtaactgcggtgagcgaccttcatgcacatggcgtcgcaacaagatcgccgtggccgccaacacgatagctagtagcaatagtccgttcaccactaagttgccactcatactagtcgtggcaatcccgtgccgctgtaaaacgcccccaaccgtggttaattctgggctcatgacccaatagagcaaccagctgagaccaaaagcagtcactgggatcagtgcaccgggaatgataatcaagcttatggccgccacgatttcgtatatcaccacccagatgggggccacgactaatcccaacgccaaactaatgactgtcattagaactcccaacaaacagccatccactaaaaagtggcggacttcaactaattgtgggttgattgcactctgaaaatgctgccgttcattctttacccgccgtttagcggttaaatagctacgcagcaatcctaaccaaagtagcggttgtaaaaaaaacaattcaaaaatctttaatacctgcatgtgcgtgacccctaacgttaaactctgaagttagtatagcatttttgcccaaggagaccaacgccgtttcaattccgtcagtcctgctattaccgctttaatatctctatattataagactagtagccaaaaaaatactaagacgacctgcgcaatgataggtcaccttagtatttgtgcaatctattgcggattacgttgggctaatttccattgtaagtaagcatccataaacggatcgaggtcaccatccatgaccgcctgcccatcatgtgattcataattagtccggtgatccttgaccatcgtatacggatgaaaaacgtaggagcgaatttgtgagccccacccaatgtccatctgctcaccttggatggccgcccgttccttagccttcttctcttcttcacgctcgtacaacttcgctcgcaacatgttcaatgctgtttggcggttctgtaattgtgaccgttgcgcttgactggcaacgacgattcccgttggcacgtgggtaatccgaaccgctgaagaagtcttgttgacatgttgtccaccggccccactggctcgataaacgtcgattttcaaatcttcaggtcgaatatcaacatccacggtatcatctaactcaggcatcacatcaacactcgcaaaagatgtgtggcgccgaccagccgcatcaaacggcgagatgcggacaaggcggtgaacacctttttctgaccgcaaataaccgtaagcattgtggccgctaattaataaggtcacactcttaatgcccgcctcatcaccagcttggtagtccaccgtttcgaccttgaaatcgtggcttgcagcccagcgcgtgtacattcttagcagcatcgcaccccaatcttgggattcagttccaccagctccgggatggatttctaaaatagcgttgttgcggtcgtacggaccgtccaaaagtaagttgagccggtactgttgtaaatcatgttcagcatgctgaaagtccgtttcaaattcagcctgcatctcagcatccggttcctcactcagtaactcataagcgactgccaagtcaccgacttcatcagctaattgcttaaacgtatcatactttcctttcaacacgttattctcatcgataactttctgggcggcagcctggtcgtcccaaaaaccgggttcggccattcgagcttcattctcttgaatgctttcgttcaaagcatctaagtcaaagcgcccccctaaagtcgtcaacagcactttgcatttcttcaatcaggtgtttatattcacttaattccacaaagaacccttctttcaacttatttattaattatttaatatcaaatttaaccgtaaaacgagcccaagaccttagtctcagactcgctagcactaacgttaagttttaacgctgaatattttggcgaatttcagacttcatgaagagccgcgtcgtatcataatcaatgtccgcgaccatttcttcaaacatctggtaaccgtctcgttgatattcaactaacggattcaactgaccatagccccgtaaaccgatcgattgccggagttgatccatcgcatcaatgtgatccgtccaatgagaatcgaccactcgcagaataacgactttttcaaattctagcatctgacccgcatcgtaaagctgtttagccttgtccgcataaatcttatcaacccggtccatcaagtaagcttcaacctcggctggcgacttacctttcaagtcagccacactaattgaatcttctttcaccatcgcagcctgggcaaagtcaacaactgcatctaagtcccagtccttggcatcgccttgcatgtgtaactgaaccgtccgttcaacggtccgcttgatcattggcataatgacaggcttcaaagatttttcttccataataacttgttgccgctcgccgtaaatcacttcacgttgcgcccgcatcacatcatcatattgtaaaacgttcttccgggaatcatagttgttcccttcaacccgtttttgagcggactcaacctgtcgagtaatcatccgtgattgaatgaccgcatcatcgtcttcaacgttcatccgttgcaagaagttcttgatccgttctgaaccgaaccggagcatcaagtcatcttcaagtgagaggtaaaattgtgacataccagggtcaccttgacgaccggcacggccccgcaattggttatcgatccgccgagattcatgacgttcagtcccaataacagcgagtcccccgacttctttaacaccaggtcccaacttgatatcggtcccccggccagccatgttggtggcaatggtaaccgcaccacgttgaccggcgtttgcaacaatgtcagcttccttcgcatggttcttggcgttcaagaccacgtgcggaatgttttcctcatccaaacgatgcgacaaatattctgacgtttccacggcaacggtcccaattaacattggttggcccttttcgtggagttgtttaatttctttaacgaccgcgttaaatttactttgtaaggttggataaagtaaatctgaacggtcatcacgaatcatcgggcggttagttggaatcgtaataacttccatgttatagatttcgcggaattcttcttgttccgtcttggccgtcccggtcatcccagatagctttttgtacatccggaataagttttggtacgtgatgttcgccatcgtcttggtttcttcttgaatctcaacgtgttccttagcttcgatcgcttgatgtaacccatctgagaaccgccgaccatccatgatccgccccgtaaaggaatcaacaatcaaggcttgaccgtctgaaatcacgtagtctttatccttcaacatgatgtagttcgcacgcaaagcttcatccaagtaatggttcaacgccgtattatcagtatcgtaaaggttttccaagccaaagtatttttcagccttccggatcccttcgtctaataatgcgaccgtcttagattccaagtcgaccttgtaatcttcatccttcgtcaacgtcttcgcaaagcggtcagcccgcttatacatgcccgttgtaccttctgattgaccagaaatgatcaatggtgtccgagcctcatcaatcaggatcgagtcaacttcatcaatgatggcaaaattcagtggtcgttgcaccatgtcttcacggtagaccaccatgttatcacgtaagtaatcgaacccaatttcaccgttcgtcgaataagtaatatcggcgttataagcggcccgtttttcttcaggcgacttttcagccccgttgatgccgacgctcattcctaaccagttatagagttcacccatttcagtcgcatcacgcgctgataagtattcattaactgtgacaacgtggacacccttaccagagatagcattcagataaactggcatagtggccgttaaggtcttcccttcaccagtcttcatttcggcaatatcaccttgatgcagaacgatcccaccgaggatttgaacgtggaatgggtataaaccaagtacccgcttcgcaccttcacgagccgttgcaaatgcttcgggcaacaaatcgtctagtgattcgccctccttgtaccgttcacgaaattctggggtcttcgcttgcaagtcagcatcacttaacttgccgtattcgtcagcataagcttcaactttattagcaatcttatccagacgccgaatagtccgcttgtcgctttcaacccagcgttttaaaatgttggccatttacgtatcctctccaaataattaatcttaattttaatttcaattgtccatttcaaaataaaataccatctgtcattttaccattatttactagcaatgaaaaccacaggcccctatgtaaccgataccgtcggccgttttatttacaaccttaactgaatgttagtgtttaccaacacctggacaatcgctgacccatgttctttaattcaacaaattccgactgtaacatcggctcgttgctcagacctgtttgatgacacgctcacttgcgacccactgagcgcggtcaccttaaccgattagtccacccgactatgacagaatacgtttcgagctaaaaataaagaactggtcagctgaccagttctcattaaatgacttgttaaaattagtgattgtcgtcggtttcaatcaaaccataacgaccatcgttacgccgatagacgatgttaattgcgtccgtttccgcgtcttcatagataaagaagtcatggccgagcatatccatttgcagaatcgcttcttcattatccattggctttaaagccactcgcttcgtgcgtacaacgtctaacttatcgtcctgatcattgtcggcagcggcaactgtttcatcagtcgctgcaaaatcaatcgctttataacccttctcacgggatttgcggttaactttagttttatacttgcgaatttggcgttccaacttgtcggtaaccaaatcaacactagcatacatatcaggagaagtttcttctgcccggagaactaaatagggaagtggaatggtgacttcgactttagccgtcttgtctgggtgaacttttaagttgacatgggcaattgagtcaacattattgtcaaagtacttctgtaacttacccacccgtttttgaacgtagtcccgaattgcttgggtcacttcgatattttcaccgcgaatattaaaatttagcatagatcttctctcccttcacacacattgctgtgtacccaaagtaattaaaggaccactctttaattactttgcttaatttcattataatagaaagcgctataataaacaatccaaatgccactttcccttgaaattaacgggctagggttagccccgtcacgctcttggcaccgttttccaaaagcaacgctgccgcgtggcgcatcgttgcccccgtggtatagatatcatctaccaataatagatgcttgccggctacgatcgcgttaggcgccaatctgaatggttgcggcgtttttagccgtgcttgccggtccttcttggattggggcaccgactttgcggttgcctgagtcactaaccccggcatgggggccacggctaaccagccagtgacctgattaaagccccgcgtctgcatcgttgtcggcgtaacgggcaccaccacataggcctcagcgtgccgttgtcccaccgctgcctgcatacttgatgcaaagacttggcgcaattggtaatcaccttgaaatttatagcgctgaaaataattgtgcatcgcctcattatattcaaagagcgcttcattgtgaaaggcgcctatttcaggccaacgctgacaatcagaacacggttgtgaccgttcttgcgcgcgtccacaactcgcacacgccgttgcccgcttgatcggcacaaattgccgccaacaggtcgagcagacggctggtcgcataaccggttgccaactaagaatccaaggcaaggtgaacttagtcgtgatggtgctgtggcacattaggcatgctggcacgtaattgtcgcccctttcgattgatcgcccgaatctggcgctgagcacgtttgatattgcgtccgtgactgtgacaaataaaccagacaagaccattcggacgatcactgctgcgaccgactcgccccgcaatctggaccaacgccgccgtcgaaaagacttcgtcgtccgcaccaagtacaatcacatcgattcccggaaacgtcaccccacgttccaagattgtcgttgttactaagtattgaaactgttgatctcgcatttgttgcaccttcgtcaatcgctcaggatcggccgaatacaccgttgcacccgtcatatggggaaaatagtgctggagcgctgcccgcactggtgccaagtgctggattcgcgggacgaatagtaaaaagcgttggtgctgctgttgataccgctgcagttgccggagcaagcaccgtggtaattttccttgctgcaatagtcgcgcccactttggctgtaaattgaccttaatcgatggtaataaatgttgatggaaacgcagtggtaaataactgatggccagctcacctcgacgaacttgcgccaacaaactttggctgggcgtcgcggtcaaataaaggaccgcaccgtccaccttggctgcctgacgcaccgcaaattctaagcgtggattagcagcaaacggaaacgcatcaacttcatcaatgatcaacacgtcaaacgcccgccgaaaacgtagcagttgatgcgtcgtacaaatcgccagttgcgtataccgatagcgttcagggttacggccatgtagcacggcaatctgagcatcggcaaaggccgcttggagccgtggtgctaactctaaacaaacgtcgactcgtggtgaagcaatcgcgactcgccatttatgcgctaacgcccacgcaatccccggaaacagcatttcggtttttccggctcccgtcaccgcccacaacaattgccgctggtgcgccataaagttagctttgattgattgcgcacaggccgcttgttgaggcgttagggtcccctgccacgtacaagccgggaccgttgcaaaagcattcggttctggcatatgatagagtttaactaacgtactcacccgacctaaattcaaacactggtagcagtaatactgctgattgggtaactgcgcccgcaatcggtccaagtgactgccgcaacgctgacagataatatggtgttcatcgacttgcattgctggtagtatctgcgtgccagtaggtaatgcggtggcctcgcttgcagataatgcgagttgccgaccgtataagctttgtgcatccatcatgcgcacctccttagttatcaagtacgccattcaacgatttattcacgaaaggaaccgattaatttgacaaaatcctactacaccatcacccaggatacagtattcgaacaaacgatcaaaaagtcccgattcatcgcacacctctaccgcatcaatgacgaagcagacgctcaagccaagattgctgctgttcgagcagataatcctaaggccaaccacaactgtttcgcttacatgcttggtgatgatgatcatattcaacgaatgagtgacgacggtgaaccagtcggaactgcgggatcaccaatcttagaagtgctcaaaaccaacgaattacacgatgtactggcggtcgtgacccgttattttggtggtatcaaactaggcgctggtgggctcatccgggcatacaatggcacccccgcgcaagcaatcgaagtcagtggtaaagtgcaacgtgtcctccaaacccgcatcgccatcacgctcgactatcgcaacgtcgatgctttaaattactatttagaacaaaataaactgacgaccctaaataccgactatggggttcaagtcacgcaagtcattgccgtcactcagtctgaaattgccacggttcagcaggcgattactgaccttctgagcggacaggtaactttttcggagcaaggcgaacaatttacagaaattccagtcaatgtgtccgataactagttgccacaggttaagcagattacaatcaaactgctgacctgcattaattggcagcccacaaactttgatttgcaatcaaaatagagctacccagctcgacttcatactgacacctaacactcgggccgatggcttgtttttcatctttataatcagtgctgcacttatcacagcccaccaaaaaagtcgagctaccgctcgactttttgtctgttatttattttaaattagtaattgcaccagattggccacgatcaaccttcatcgaagtcaatggaatgtaccctaatttttcaactaagctaccttgaacggctttagaagtcatgtaggttaagaagttcttcaactctccagttggttgtcccttagtatacatgtgttcataagcccaaatcttccacttgttcgtcgccacgttggcttcggttggtttgacgttatcaatggaaagtgcttgaacgtcgctcttaacgtatgagaatgctaagtagctgatggcaccaggcgtggtgctaacgatcttttgaaccgtcccattcgaatcttgttcttggctcgttgcaactttcgcgttgtctaatccccatttttcaaacgttgcccgggtcccactgccttgagcacggttaaccacggtaatcttttcatccttaccgccaacatctttccagttagtgatcttgccttggaaaatcttgataagttgttcttttgaaatattagtgacaccggcatccttattaataacaggtgccatccccacaacggccactttatggtcaactaaccctttggcgtctaatcctttttgttcctgtgcaaataaatcagaattcccaatattgactgaacccttcgccacttgactcaagccggctccagacccaccaccctgaacgttgatggtcacgttcgaatgttcgttctggtaagcctgtccagcctgttccactaatggttgtaaagcggttgaaccagttgcaacgatcttagtagtcttagaactaccactactgctactagtactcttcgtacttgtggctgagctactgccgcaaccagctagtaaaatggtcatcgttactgccaatgcgccgagtgtcagtgcttttttcataattgaaactccccttcttcaattgactatcaaaattaagcaaccaacccggcaaccatcatagcaaaactgggtaggagtgctacgactagtgatggagcaacatcaccgtccgacggttacacgtaattgattgcttcggaacatgcttaatattactaatcgtttgtaaattgtgaatgacgattgtgtaaattgcttgtatagttttggtaaagttaagattgatgaaccaactgatgaccaactaaaaacaggcatcaccgctaatcacacggtagatgcctgtaacactttaataattttcaatgatttatttggtttttaatgattactcttggaggtcaaacgcgcgacggtccgtttgatccaatccagtagcggttgccgattgtcaccagctaatccgattgcttcaacgaataactctagcccaaataataaaccaatcgtcaataacacagaaccccaaatagatgagatcggatagagcaatgaaataaatgagaaaataagtgcaatcccataaattaccatcacagtctgtcgatgggtcaatcctagttgcatcaagcggtggtgcagatgatgtttgtctgcttgcgagatgggctttttattcaaaatccgccgaatcatcgcatacaccgtatccgtaattggcacgcccaggatcatgaccgggatacccactgaaatcaaggtcacgtttttcaaaccaaacagcgagaatacggccgtcataaaaccgataaacagcgacccggtatcaccgagataaattctagctggaaagaaattatatggtagaaaaccaatcattgccgcaaccaaagtaaaaatcaacaatgaaacgaacatattggcattcaagaagaacagcccgatgattcccatggtactcaacgaaataatcgaaacaccggtcgccagtccatccaacccatcaattaaattcaccgcgtttgtgatggccaagatccacagtaaggtcactggcaagctcaaccactgaaagtgaatcaatcccagcaacgggaacgtgaaggtcgtcattcgaataccaccgataaagtagacctctaaggcagctaacgtaattcctaacatcttctgacgtggttttaattcataaatatcatcgataacgccagtcgcaataataatcagctcaccaccgagtagtgcgaaaaaaatgcgactaggaaactgatgcatgagatacaagacagtcgttccaccggtgtaggaaataaagattgccaagccacccattgtcggcatcggaatcttattgacccgtcgtacatttggtttatccacggcaccaattttaaatgcaagtttccgcacaaacggcgtcaagatcgcagaaagtatcatggtcgccactaggcttactaggatttcaaatctgatcatttgtgcgtaactcccttctcactctattacgataattatacaaatcccagtgacgcttgacaacttgcttcactaaaacttagtaaaggcaacacaattcgttcacatttgcgagccactaagctgattaagtatctaaattataaccttagttactcatatttgacataaaaataaaaacccggtagctataccgggtttcaatactaagtcactattcttttaaatggtaattataagtcgaaacaataatattttcacgtgaatttaataccgcgcgtaatcgtagactcgtttgattatgcaagatgttctgccatggcttcttcggtacgaattgtggcacgagcacggttgtcgagaagttacgttccgcggcacgcttagcaatcacatcacagaatcgtaatgtcggtgtcgcaatcgaccgatatgatgaatgaatatccacgaaacggacgtctgggaaggtctctttgaactcggccgccgtcttatgttccttttcaggattttcatcaaaggagacgtgcatcgcaatgacataatccccgatggaccgcgcgtagttgactgcttgagccgtgacccgcgtcacattcgagacgaggacgatcaccgtcgcaccgtcgtaatcatgaatcgccgctttttccttggcgaccacccgtaactgggccgcaacccgattatagtgcacgtggatgcggtagaacatgtacagtaagagtggcatcacaatcaagtatggccaaacattgccgaaatgtagcaagaataggaaaatcactaggagaattgaaatcaacgcccccagtaagtttaccgccgccttcatccaccaccattggccccgttcacggaaccagtggataatcatgccggattgtgacaaggtaaatggcacgaagacccccaccgcatacagtggaatcaaaagtgtcgtcttaccatggaagataaagatcaacgcaattgcgccgaccgccaacgagataatcccattagagtaacccaaacggtccccacggtccatgtaagcatgtggtagaaatttatccttggctaaattatacgccaagattggaaacgctgagaaaccggtgttggccgcaacggctaaaattaatgccgttgctaactgtaacaagtagtagaacaagccatgaccaaagaccgccgtagcaatttgtgacaagacggtgttgtctgcttgtggtttaatgcctaagtaataacttaagtaagtaatcccaccaaagaagacagccaagaccaaggacatgattgctagcgtattcgccgcattcttgcgtttcggccgcttgaagttcggtaccgcgttactgatggcttccaccccagtcagcgaggacgaaccggaagaaaaggcccgtaagaacagcaccagggtcatcccttgaacgggcgccccaactgctgcggaggcgtggtaagttaagttaccactcgcaatattcataacgccccacagaatcatgccgataatcataataatgaaaaaataaacggggaacgttaagaatgacgctgattcgcgcattccacgcaaatttaacgccatgatggcgatgacaatcagtacggcaatcaatacttgataattagctagcgccggaatcgccgacgtgattgcttcagtaccagaagtgacggaaaccgctacggtcagcatgtaatcgactaacagtgagcccccggcaactaatccggctggccgcccccagttcgtacttgccaccacgtaggcgccaccgccagatggataagcccgaataatttgtcggtacgacatcgtaatagcaaacaacagcactaacacaagcgccgccacgtacaattgatacatcaacgcggccgctgaaagtgtaatcaaaacggtcgtaatctgttcagtaccgtaagccaccgatgatagcgcatctgacgatagcagcgccagtgccttgaacttggtgagtgcttgcccaccctcgtccatggtttttaacggtttcccaataactaaccgctttaaataacgccacatgataataactcctttattccaaaataattatcccaaagtaaactgagtcaaagtagattctactactttaccctgccaaatactaccagttaaatgtcgggtgcttcgccgcacccacattttgcgttaacgactaatcctaccgctctaatatggataaatcaatacctttattctagtcgattcacaccctaacagcactaaaaaagcacttactcagccgagtaagtgcttaatgttacgatttgtttacatcataccgcccatacctgggtttggtgcggctggtgcagctggtgcattttcttcaggtttttcagcaacaacggcttcagtcgttaagagaagggctgaaacagaagcggcattttgtaaagcagaacgcgttaccttagttgggtccacgataccagctttgatcatgtcaacccattcatcagttgcggcgttgaaaccaacacctggcttttgttccttcatcttttcaacgataacagagccttccaaaccagcattttcagcgatttggcgaactggttcttccaaagcacgtttaacaatgttgatcccagtttgaacgtcaccagtttccttcaatgcagcaacatctttgataacgttaatcaaagcagtaccaccaccagcaacaaagccttcttcaacggcggcccgagttgcgttcaaagcatcttcaatccggtatttacgttccttcaattcagtttcagtagcggcaccgacacgaacaacggcaaccccaccagctaatttagctaaacgttcttgtaacttttctttgtcaaagtcagaagttgtttcaccgatttggttacggataaattcaacccgttctgagatagcatccttggaaccagcgccttcaacaatggtggtgttatccttagtaaccgtaactttgttggcttgacctaattgatcgatggtcgtgtccttcaattcaaggccaaggtcgtcagtgataaccgtcccgccagttaagatagcgatatcttgtaattgttccttacgccgatcaccaaaaccgggtgccttaacggcgacaacgttaaacgtcccacgcatcttgttcaagactaaggttggtaaagcttcaccagaaatgtcatcagcaatgatcaacaatggcttgccttgttcaacgatggattgtaatagtggtaagatatcttgaatgtttgaaatcttcttatcagtaattaagatatatggattgtcaagatccgcttccatcttatcattatcagtaaccatgtattgtgataagtagccgcggtcgaattgcatcccttcaacaacgtctaagctagtatcaacaccacgtgattcttcaatcgtgataacaccgtcatgaccaactttttccatggcttcggcaatcaatttaccagtttcttcacttgctgaagatacagaagcgatttgcgcaatatcttcttgcgtcttaacttcgtgtgccatagcgtgtaatgagtcaaccgccgtcttagtagcttcttcaatcccccgacgaatgccaacagggttagcaccggccgtaacgttcttcataccttcattaacgattgattgtgttaagaccgttgcagtagtcgtcccatcaccagcgatgtcattagtctttgaagcaacttcagaaactaacttagcacccatgttttcgaaatgatcgtctaattcgatcgccttagcaatcgttacaccatcattagtaattgttggtgaaccatatgattgttccaaaacaacgttgcgacccttaggacctaacgttgacttaactgtgtcagctaattgatcgacaccttttagcatcgctgaacgtgcatcttcagagaactttaattctttagccattatctctattcacctcatgaatttaatttattttaagttgcgcaatttaaatggattagtcttcgattgcaacgatatctttttcgtgcaataccaaatacttagcaccttgatacttgacttcggtaccggcatacttatcgaataatacttgatcgccgaccttcacgctggggtcaacttttgtcccgttatctaaaacacgaccgtcattgacggcaacaaccttaccgctttggggcttttccttagcgttattggcaatgacaataccgccaattgtttgttcttcttcttcttgttgttgcaagataacgcgatctcctaatggttttaacacgtgaatccctccatttattcttttttagcactcctcaacctcaagtgctaattacattgtcaactatatcattttaattcaagattgcaagtgatttgtcaattattagtcaaagaatgtcaaatcgactataatgaatactattgaagtatcaataaatcttaaatcaaacttttaaaaggacgtgacttgatggttaatcgccgccaatcaatctttattcttatcatctactttattatttacgcactaccgagcgtccttgtgactgctttccatcagctaggggcccaagtattcgtgattcaaacggtcgactacttagtcggtgcaatcctactcatctggttggcgagtcgcatgcggacaaaaaacgttgttgaaaaacaaccaagtaactggttcatgacgttcatctggggattgattggacttatcctagtcatcctcggtcaagtcattattttaaaaatcacggctttgatgggccaatcaacagcctcaaccaacacgaccaccctcttaaccgttgggcaacaatatcccgcgttcttcctagccatcattgtcggtgcacccattatggaagaaatcgtcttccgcaaagttatctttggtaatctaagtgcggtcaccggccaaatcggcgcggccttgatttccagtgtgctatttagttttgcacatgcggatggtcactttatcctctacgcctttatcgggttattattctgctggctatatcggcacaccggtcggattcaaacgtcaatgacggcgcacatcttaatgaatgcctcggtcgtgttacctacgttattagggctagtacactaacataacttctaggccaaacgattacggttggcgttcaccagctattgactcttagtacgcgaaaaggcttccctgaaaaattcagagaagctttttcgtatcagtttaacctcaaagatgaaactgattattaatcttcagtctcattttcatcgtcattaccattgtcacctaattgctgaccgtaatgttcaatgaagtagatcaatgtttgtaattcgttggtcaaatcaacgttctgcacccgtactgtctccggaacggagattcgtaacggcgtgaagttcatgattcctttgacgtttgcatcaaccaagtcatcggtaattttctgaacaaccgtggttggtaccgttaagatagcaatctcaatctgttgttcgatcaattgctttttgagctccgtcattgggtacactggaaccccactttggaccgtattggcaatcgcctcgttgacatcaaatgctgctgagatgcggacattactgtttttgtgaaaattaaagttcagtagggcgtggcccaaattaccgaccccaattaaagcaacattcgttaaggtgtcttgatttaaaatctttttaaaaaatgcgagtaacgtttcaacgtcgtatccataccctcgttttccgagcgccccaaaatacgagaaatctcgccgaatcgttgctgaatctactttaaccgcctcggacaactcggtcgatgagacccgcttcttatctgcatctagcaagatatttaagtagcggtaataaatcggtaaccgttttgccgttgcccgtggaatttttgtttctgccattcggacgtgtcctcctaattaaaagtttgtgaatttgctgacactattctagcataacgtgtgactttgtgaaataataattacttattattcctaataattgggtcagaccgttacaatatgctacaattatgtcacgaattaaatgtgaaaggagcttaataaagcgtgattttactacaagtacagcaagttatgcggcgttttggcgccgatgtcttgttcgataacgtacaaatggacattcaagaacacgcccgggtagccctcgtcggtcgaaacggggccggaaaatcaaccttacttaaaatgattgccggtgaaacggtaccggacgaaggccagatttcaatgcgtaagggcttaacgatcggttacttggcgcaagaccaggggctagatagcaacaatacgatttgggaagaaatgagtagcgtcttcgctgagttacatgccatcgaaaaacggatgcatcagctcgaaaatcaattgagtgaccccgcaatcatgaatgatgagcaggcttatcaacagacgttgaaaacctatgatcaaattcagacggaatttcaacagaaaaacggctacggttaccaagccgagattcgaggcgtgctgcacggttttcaattcgacgccgacgtgtacgataagtcggtcacggcactatctggtgggcaaaagacccagttggccttggccaagttgttacttgaaaaacgggacttactcatccttgacgaaccgacgaaccatttggacgtcgaaacccttacttggttggaaagttatctccaatcttattccggcgcgctgctaatcgtcagccatgaccgctatttcttagaccgggtcgttaacgaagtctatgacttatcacaccacgaaatggtgcactacactggcaactacgaccagtttgtgcaagaaaaagcggcccgaattcaagcacagtggaaacattacgaaaaacaacaggcagaaatcagcaaacttgaagactttgttaatcgtaacattgtgcgtgcttctacgacaaaacgcgcccaggctcggcggaagcagttagccaagatggaccgccttgaccgccctgatagtgacgagaaaactgcccactttggctttcatgcggctaaacaaagcggcaacattgtgttgaccgtcaaagatgcagccgtgggctatgatggtcagattctttcggaacccgacaacttgaatattaagaaacatgaagctattgctatcgttggaccgaacggtattggcaaatcgactttcctaaagagtattttgggacagattccattcattaaaggccaggccgtttttggcaccaacgtcgttacgggctactatgatcaagagcaacgtaatttaaacgacaaaaaaaccgtcctcagtgaactttgggatgaacatcccaccactcctgaaaaagacattcggaccattttgggcagctttctcttcactggtgaagacgttgataaacccgttcatgccctatctggtggcgaacgggcccgattactgttgaccaaacttgccatgcaaaatgacaacttcttaatcttagatgaaccaactaaccacttggatatcgatagccgtgaagttttggaagtcgccctcaacgactttgacggcacccttttattcgtgtcacatgaccgctacttcatcaaccaagtcgccacgagtgtcgtagaggtttctccggaaggcacggaactcttcttaggtaattacgactactacatcgacaagaaacaagaacaagctgaaatcgcggctgcggctgctagccaagcggccgaaaaagctgctgaagccagtgcagcgtattcaaccagtgccaccaatgctgctccccgctccaaaggccagcaaaattaccaagccagcaagcagcaacagcgtgaaaaacgtaagcttgaacgctcagttgccgccctggaagaacagatgactgccttagatggacaagccacacagattcaaactgaaatggcgcaacctgaagtatcggccgatgttggtaaactacaagacctacaaaaagaacttgaagccatcaatgctcaacaagaacaagttgaaaccgaatggaccgaacaagccgaagctttagaagaactgaactaactttccaacaactcatcagataaaaataatagtcgccgcaagaattaatacacttcttgcggcgactattattttgcccctatccgcggcataaatcatgattaaaagaggatgattcctagaatcaaaaacgaccagcttaggcccgctggaaacagttcgggttagcgtaaacctgcttagttcgttcgtcctacaccgacctccaggcatttctgccaattgccggaacgtggtgggcacagatttaagccgaagcccacgtcttaaatactggcctttcactaacccagcaaagaacgcttgctaagtgaaatttcaccactgggcattgtcagaaacgccttccagtcgggatagtattcgaatggcagactgtgaggtacccaacttttgatgaattggtcgttgcttttcataaatggtaattttgtcaatcaactgtcagactgaaagtaatattgagatagcttactattttggaatcaccatagtaataatcgagcacctcaacaaagtagttaatgtaatcttaaagtcttgtttaaagttccattatcaaaatagccaacgaccaattgtaccaagttaagtggccgttcatcagccattcgagcggcttaccgaccggaggggctgggtgacaatgctcagtagccaaattattcttagtcggaagtgtttttcttccggcttagaataagactcgtatttgagatgacgcgggttgtgcgttagctcaaatcgatgtcggcttacgttccagcaattgtcacccagccccggaggtcggaataggacgcgcaccggctgacgaacaggaatccacctaaccggcacgttttaatcataattaatgaaaagatactaaaacgggtgtggtaagaattgacttttcacacccgtttataactgcttcattacttcaacatgcctggcatccaatcaaattctaaacttggatcggcattcagcgacgcgtcgccgaattggtgatgctgatattgaacatagcccgcagcaccaatcatggcaccattatcaccgcatagctttagaggcgctaagattagttcggtgtcagggaaagcggttggtagattttgttgtaaccgttcacgtagcccctggttcgctgcaaccccaccggctaagactaattgcttaactggatattgtttgaggacacgtaacgtcttactcatcagaacatcaaccacgctggcttgaaagctagccgctaaatcgttcttatccagcgtcgcgtcaatttgatctgcgtgatgaaccgtattgatgaacgcgctcttcagcccactaaaactgaaatcatagttgtcttcatcaatcattgctcgtggaaatttaaaggtatcgtgacctgcatgggccatctcatcaatgactttacctgccggataaggaacacccaatacccgaccgattttatcataggcttcaccagcggcatcgtcacgtgtctcaccaataatttcaaactgcccatccgcttgcatgtagaccaattcagtatgaccgccagaaactaatagtgccattagcggaaattcgaacggcttaacaaaccgagcggcataaatgtgaccagccatatggttgactggaatcaacggcaagtggtgagcgtatgccaccgtcttggctgcattgacgccaactaacagtgccccgactaacccgggaccatacgttacggcgaccgcatccaagtcagcatacgtcacgtgcgcctcttgaagtgcggcttcaatacaaattgtaatttgttcaatatgatgacggctggcaacttcaggaaccacgccaccaaaccgtttgtgactattaatctgagttgcaatcacgttggataaaatctcatggccatttttaattactgccacactggtctcatcacaactggactcaaacgctaaaatcaagttttgtttttccacggttcccatccttttaattaatcattttacgcatgatccacgcatcttcttcaggatcatgataatactttttacgcgtggcaatctggtcaaagccacattgctgatacaagcgctgagcggcgagattactggcccggacttctaggaatacgggtcctgccgataattgtgctaagcaggctgttaataaccaccgcgcatgcccttgacgctgataggccggatcaattgcaatattcgtaatttcggtctcatcaagcaccgttgagcggctgacaaacccgatcagttcatcctgccaccgtaataaatcatagtgtaccgttggtaacgccatgtccgccgcaaacgttgcttgccgccaaggtgcaccaccgggatatgctaacgtcgctaactggtaacaaactcggacggcttcgtccgcgtcaagctgcgtactggcgacaagccgccgttcagtcatccgtagctaccggaatacgataagtcatatcaatagcatcttcatggtcgccaaaatagtagcgtttcttgatgctggtcttttcaaaccctaaatcgcggtaaagttgttgcgcaatcgtattactgtaacgaacctcaagggtcaccgtttggtaatgcaacttacgcgcccgcttcatcatgacttgcatcataaaatggccgagtccctgaccttgaacatcgggatggacagcaatattggtgatatgtgcatcttggcggcgatcatcaaagacacaaccacagaaagcgacgaggcgatcttcatgacgcatcacaatatagaagcgaccactctgtcggcgaagttccgtcttaaacgcattttcatcccacggtgtttgccccgcatatacggcccgttcaatggctagcatctcgggcacgtcggtaatcagtgcgcgtgagacatagtaattgacttcgcccacttttacgatgtgattctgaatagccaatatgcgttggcggcgctgattgccaccggtcgtcattttctgaaagtactccttaaattttctcaacatagggcgcatgttccttttctgggtgcttggcttgccaatcacgttcagcttgcgttaaacgcaaatagtttggcacaaagttatgaatttcactcacaggtgtcatcgttcgacccatcaagccgagtaccacggcctggggcaaatcaagttgtggcgctgctcgcacgaactgcttggctaacgattgctgcaaaacttctgcgtattgatcgacgtcggcgccgacaaaagtaatcggctcgttatagctcgccaatcgttggccccactcggtcacgctgatatgctgatcggcgataacggcaactgggtgctggttctgaatccgatataacccggcaaagatgttatcacgacgcgcatcaaataacggcgccactaattggccttccgtcacaatgttgccagctaacacggccaaactcgatacaccaactaaggctttatctaatgtaaaggcaagtgttttagcagtcgtcacgccaattcgcaaccccgtatacgaccctggtccggcagcaacgacgatccggtctaaatcagctggtgccaatttagcttgagccatggcttgttcaataatcggtaataatgtactactgtggttacggccaacattagtggtcgttgtggccaagatctgggtatcttctaataccgcgacactcaatggccgattcgaagtatcaatcgccaacaacttcataattttaaaaaactcctcattttgaattacttcacatatcttatcataatttacttactttgaaagctttacggtagtaaccaaccaattcaatccagaaacaatcaacaactatcctgaccagtttccactcatacttaccaatcactgaattgaaaaccgaatgtaaatattatttacataacttatacatatacttcactaatccttgtctgcacatttacaataccttgttatgctacacaagtaactaaaattacttggaggtaattggaaactatgtcaaaagttagtaagtcattattaggtctttcattcatttcggttttaggtttaggactcgcaggttgcgctagcggaaccagtgctaaatctggtggcagcagtacggatagcagcaaaaccatcacggtggtcttctatcctaacgaatcagcgaagagttttgctggttcccgtacggccattaagcaagcagttgaaaaggcaacgggtaagacggttaaattacaaactacgaccgactataacgttgcgattcaagcaattgcatccggtaaagctcaagttgcatacatgggtgctaacggttatatccaagcacaccataagagcaaagacgttgtgccgtttgccgcacaatccgatgctaagggaacgttgaaggacgctacttataactcctacttaatggtacaacaaaaagatgccaaaaagtatgaagaaaacggtaagtacagcattaagaacgtcaaaggcaagaaaatgtcttacgtctccaacagttcaacttcaggcttcttagttccaacagctgaaatctcacgtgaattcaacatcaaaactgctgaccaagataaattaactcaaagcggatcattctttagtaaagtgctctatggtggctctcatcagggttccgcggtcaacttactcaagggggatgcggatgtcgctgcctttgatgatgctgatttaatgccatacttaaacgttaccaagggatcatgggacaaggtcggctcaactttcactgttaaggataacgccgaagcgccatttacaagtttagccggcaagtcggtcgttaacattgccatgatgcctgttcaacaaggcccatgggtatacaataccaaggccctcagcaaggatgatcaaaagaagatcgccactgagttcacgtcgaagtcctttgcccaaaacaaaaagatcttctctgaaccaaatgcgaagacaccaatgatgttccctaagaaatcagaaaagtccaaattagttaatgttaccgacaagtggtacgcgccaacgcataagttagtaggttactaaaccacgtaccattagttcacaatgaaaggatttgccaatgctcaaggttattcagctagataaaacatatggttccaataagcattcgctcaaagcagtcaacttcacagctaaaccgggcgaagtaactgccatcatcggcccgtctggtgctggtaaaacaactattttacggagtatcaatcagttgatccgcgatgatagtggtcaaattttgctcgatgacactgacattcgtcaagcgaacaaagctgaattacgcaaagttcgtcatcatatcggcatgattttccaaaactacaatctgatcagtccgttaacggcccttgaaaatgttctgcatggccgcttaggcgctaaatcaacagttgctggcatgctcggcctttacagtagcgccgaaaaacaagaggcgctacaactactcgacgaagtagggttaaaagaatacgcctaccaacgttgcgatcaattaagtggtggccaacaacaacgggtcgggatcgcacgggcattaatgcaacatcctaaaatgattttatgtgatgaaccgattgcttccctagatcccaaatcaacgaccattgtcatggacattctacggcgattggcaaaggaaaaacaactgattatcctcattaatctacatcaggtcgatatcgcaatggcgtacaccgaccatatcgtcggcattaacagcggcgccatcgttttcgaaggcgccactaatgaagttgacgacacggtcttacaacacatttatcgccaacctgaccaatcaacggcggtggctgccaatgaaaactaatccaatgacaccgcaacgcttttttcggcaacgtcggttgcgattatcagttgttttgctcattttaattggcatctacgtcttatccatggccctcgttaattttcaggcgtgggcttcgatcagtaagattccagcgggcttaatgtggttgtttaccaactttattccgacaagtcgttcgatttcttatctgggaccgattctttatcagctgtggcggaccttgctcgtggcaatttcatcaaccatggttgctagtctattcgccctgatttttgcaatcttgggtgctaagacgaccaccccaacgcctgtcctccgctggattattcgttttggtgcttcactcttacgtaatattccggtggtcgcttgggcgatgattcttctgttttcttttaaacagagtgactttacgggcttcttggcactgttctttatgacgctaggctatctaacacgggcctttactgaaactattgaggacctcgatgccgaaaagcttcaagcactgcaagccgttggcgccaactatttccaatgtgtcttctgtggggtgttacccgaagccgctagtaccttgactagttggattctctacatgattgaaaacaacttacgggacgcaaccttggtcgggctcttgacgggtacaggtgttggttttctctttgactactattttaaggcgttccgctatgacgctgctggtctaattgttttgttaattgcgattttagtcattgttttagaattgacatctaatcgaattcggagggcaattgcatgattgaaaacagtcaacccaaaacacaagtacttcaaccgtcagcaccaccaacccagtcgatttcattggtgactcggccccgcaaaatcctgcgagccgttatgattggcctaacgctgatcagtgtctattcattagtcacactcaataatgccaacctgaacatcattgacgctttgcatagcttaggtctcaacctgaatgctatgttcttacaccctagcgttggtcaagacacactggggcaactcttacgggccctaatgactagtgtttcattagcgctgttgacgactttgttaggagcgctaatcgccttcttcattgccgtcggtgctgcccgtaacttagcacccagttggttagctactagtattaaagcagtcatggcctttattcgtgccattccaacgattttatgggtgttaatttactccgtagtcatgggattaggtgctagtgccgccgtggtcggcttgaccttccacagtgtagcgtacctggttaaggcctattctgaaagtattgaagaaacctcgcaagatacgattgaagcgttaaaggcgagtggcgtgggtttttggccaattgtttttcaggccattcttccgtcaatcattccagcactgcttagctggacgtttatccggtttgaaattaactttgccaatgcggtcgccgttggggctgcagccggtgctgacgatatcggttactacctcttcatggctggtagtttctactttgatttccatgaagttggtttgattgtctacctactcttgggtgtcgcaatcgtgctcgaactggtttctatgcggttacgtggccactacttaaagaacaactaagtaaattcaaaggagttttcatcaatgacaattaaagcagtaatttttgactgggccggtacgaccattgactatggcagccgggcgcccatcgtggctttccaaaaagcctttgccaacgttggtattcaaatctctgaagctgagattcgccaagatatgggactagataagtacacccatatttataaaatcatggatttaccagccgttcaaaacgactggcaggcacgtttccaagtcttaccgactgaagacgactgcaatcaaatctttagcaacttcaaagcaatcttgcttagctctctaactgaattcgggcaattaaaacccggtatgtcagccgtaattgattatttagaggcccacaatatcagctatggcacgaccaccggctacgacgctgaaatgttagccttagtcttaccgattgcggctaagcaaggctatcggcccgccgtcaacatcacttcagaacaaactggcggtgttggtcgacctgcgccggcaatgcttgcgttagccgctgaacagctcaccatcaccgatccaacgaccgtcatgaaaatcggagattccgttaatgatatcttagaaggcaataatgccaatgctgtatctgtagggattattgatggtagcaacatcatgggactttcggagttagccttcaacgcccttagcccggccgaacaagctgaacgacgagcccacgtcactgccgcttatcaacgcgctggtgccgattacattttacaatcgatggctgaattaccggcattgcttgatcaaatcaatcaaccggttgccactgatcattagcagacaaggagcccgatttttatgaaacaaccttatttactcctaacacccggtccactcagtacaactgccagtgttaaggacgcaatgcaaattgattattgtacttgggatagtgactatcggcacgtcactgaaaccattcggcaacaaatcttagctatggcccaagccaatccagaaaactatacgaccgtcctactacaaggaagcggcagttttggtgttgaggccaccattggcacagcagtaccacggaccgatgcgactttaatgattgccattaacggcgcatatgggcatcggatcagtcaaatcgcggaatattacgatattccacatatcgacgttgtgttcaacgaagatgaagccgtcgatccggttcggattgaagcaaccttggctgaccatccggagattacccacttcgcaaccgttcatagcgaaacgacaactgggattctcaacccaatcgaagccttaatgcctatcatgcatgaacacgggatcgtaacgatcatcgatgccatgtccagtttaggtggcgtcccgattaacattgatgaattggattgtgactacttgattagtagtgccaacaagtgtgtgcaaggcgtgcccggttttgcgttcatcattgcaaaacaagcgaccttggcccacactgctgacaacgctcgttcactttgtctagatctctacgaccaatggcaagccatgaccaagcaaccaggaaaatggcgcttcacttcgccaacccacgtggtacatgcctttgcgcaagcactcattgaattgcaagcagaaggcggcgtgacaccacgctaccaacgttaccgtgctagtcaacaactccttagcgacggcttacaagcgctaggttttgaattagtgattgatccagccattcaagggcccatcattacgtcattcaaatacccgaacgtcgactttgattttgctgacttctatcagttcatcaagcaacgcggcttcgtcatttatcctgggaaggtttcaaatatccctagcttcagaattggtaccatcggtgatgttgatacaactgatattcaacgactcttaacaattatcggtgattatcaacaacttcaccgctaactacattgatcaatctaaaaggtgcgtgccaaggactcaatcctgacatgcaccttttttgacgaccacaaaagcggctttgaaatctattgacgagatttcaaagccgctttcaattatcagctaaccgatactagtcacgatcatcgtagccattgggatgcttctgcgtccaagcccacgctgtttcaataatatcgttaacattgtcataatttggttgccaacctagcacgtcacgcgccttatcactcgccgcaaccaatgagtctggatcaccaggccgccgtggtgctagcttagctggaattggttgcccggtaacttcacgagcagccgctaacatttgtttgttagagaaacccgttgaagaacccaggttaaaggcattactgtcatttcctgcagccaagtacttcaaagccaagatatgtgcatcagctaagtcgataacatgcacatagtcacgcacattcgtcccatccggcgtattatagtcatcgccgaagattttaagttcatcgcgttttccttgcgcaacttgtaaaatgattggaaccagatgtgtttcggggccatgatcttcgccaatactgccatctggcttggcacccgcaacgttaaagtaacgtaacgcgacaaacttaataccataggcaacgtccgcccagtgcataatttgttccatcattaacttgctagcgccatacgggttgattggtaactgtggatcagtttctttaattggaatctgcttaggtgtcccataagtagcggccgttgatgagaagacgatttgcttcacatcatgggcctgcatcgtttcaagtaacgtgatcatcccaccagtattgttatcaaagtacttcagtggcttactcattgattctggtacgattgaaaaggcggcaaaatgcacgacagcttcaatgtcctcagtatcaaaaacgtgattcaaaaaatccgcatcccgcaaatcaccctgataaaacttggccgccgaattaacagcagcacggtgtcccgtgaccaaattatcaacgaccacgacgtccgtaccgtgttctactaaccgatcgaccatgtgagaaccaatgtagccagctccccctaaaactaaaattgacataatgaacctcccctgtatggatgtattaatcatagcatactgaatcgccagcgactctaataaaaacgtgcgttctaatcgaccaagtcgctcacgatcacatcattaacacactagtgtaaataccaacccagcaaattactgaatcggctctggtaaagtccgccattgaatcgtgacctcacaacacttctcatcatcaacttcgatcaaatgactcgtcgtgacctgatcggccacttcgctcggtaagatgttcgcatgagcagtcaccgtttgcccgtacttgacttcattttcatagcgaacatcaacgtgaactaaatcatgttgaagcaagaacgtcgcgggtagcgtatctacgagccaatcaaaatagtgtgcattattaacatgccggttgggatcaatgtcaaagaagcggacatggtacggcttcgtaatcgttgtatcggtcgcttcaaaactaatcggtcgtggcaagcgcggaatacgcttgacgacttccgactgatacggcgcgaccagttctggtaaaatttttacgattcgccgggtcgtttgactcatcatgacccagatactcgtaatataggccaactgttgaccatctgcgtcccgaatccaaaattcacggtaagcaaaatatggattataagcactaccccgaacggcaatcgtaacgacttcgtcttggcggggcatccgtgtaatatcgatggcatattgcgtgacgacccaaccaacaccatggctttgcaccatttccgtcgttaaaccaagggcgtcgctttgatcctctgatgccaatacggcaatatcaattaatgtcgttaaggttgcgcgaccagtgcggtcacattcataatacgtaatccggtgctgttcactgtaaagactcgcatttgcgcctaaagttgccattcatcaagactcctcatcgttggtatttagttcatgaaactgattataaacgctttgccggggaatattccgtcgcttcgcaatcgtcttaatggccacgttgggcttatctccggctgcaatcaacgcttcgacttgggctttgactggcaactgtgccaattcatccgttgtttctggttcatccttatccggattaccaccgatcaaaaggacaaattcgccctttaactgatgatcctgcgcccacgtcaccatttcagccaaggttccacgcgcgaattcctcgtaacgcttagtcaattcccggcacgccacaattggccgcgtcccttcacagacggtcgctaggagggtcaaggtcttggcaacacggaatggcgattcgtacaagaccactgtttcatgtcgccgagccaatttagctaaatcagctttttgttcattcttcttacgcggtaaaaagccgtagaaataaaatggctgtggcactaggccagaagcaatcagcgcagtcaggccggcattggcacctggtagtggcacgactggaatattcgcggcaatgcaggctgccacaagttctttgccgggatcactgattgacggcatccccgcatcgctaacttgtgctaagttaacgcccgtctgtaatttttcaattaactggggaatccgttcttgggtgttatgttcatgaaagctaatttgtttcgttgtaatttcaaaatgattcaataacttttgggtattccgggtatcttctgcggcaattaggtcaaccgttttaagcgtcgccactgcccgataagtcatatcctgtaagttgccaattggcgtcggtactaagtacaaggtcccgatacccgcatgatctgcaaaactttgttgtgtttccaaaacgtcctcctaacaatcctctcgaccgtgacttgttcctatgagtgactcgtggtgaaaagcacaaaaagtctgggactactcccagactttttcgactatgcgcgttcacgttcaccataaatgacttccaaacaaaaaacgcaggattcgtcatcgtcacgccgtttgccgtaaaactggttgcagacgtggaagccctcatcatagagtttttccaagttttgccgtgactttgagagcgtggtcgtgctagccgcttttttcggcaattcattttcaatttcgaccatgtgttcacgtaaatgttcattttcaatgaccaattccgcgtttttctctaacaccgttgtcatatcggcgcgtaacttagccattttgtctagcatttgttgcatctgttgttccatttcaccgaaactatcgtataaatcacgcttatccacgcgctcaccctcgttttcctttatttaagcgtttgtttgaaaaatcggccataactttaacgttaagccttctaagacattttgaaaactaatattgctagctagctggcgcttggccgttaaagctagttctgtcgccgcaatcaactgctcatcgctgacttcagccgttaacccggccaattctttttggtactgaccaaaggttaacgctgtcgttgccacctcaaaatgtaattgcaatagatcttggaacaaggccgcaatgaaatccaacataaccagctgatgatcagcgtccttagccaaaccaactaaattgacctgcacagccacaaaactccgtgggtcacccttaacagcctggtcaaaccaccgccacaatgcttgcgcagcttgtggtaaccaatcatccgctagcaacgcctgcgcctgggtcacgctatttgtcaggccccgtaacatctgtgcttggtttggcgcaatcccggcctgttcaaacgtctgctgtaacgcctgcgcatttaatggtgggaattcgatcacctgggttcgtgaaataatcgttggtagcatcagttgcttattagtcgttaataacaaggccgtgacgttaccacttggctcctcaataaacttcaataagctattggcagcactcgctgtcatcttctccgcatcattaatgatgaacagtttccggttaccttcgaccgcactcttagagaattcagcttttaagtaacgaacctgatcaacgtgaattcgctgaccctcgggagccactgtcacaatatcagggtgcgacccattagcaatccggacgcactcctcacaagtgccatctggttcaccatcattaatatgcaggcagaacaaccgttgcgcaatccaatgggccagttctggttgtccagcgccttccatccccgcgaataagtacgcgtgggccagatggttctgggcgatgatgtgtttaaatgccgctaataagcggggctgtttcgccgctaacgtttgcgcaaatgactcggttgttgccattaataatcatccttcattaaaattggtgaaattgttcaattggtagaacaaagaccgtggcgccaccgacttgaacttcaactggataggcagctgcgccatccatcgtcacgtctagattgactggtggtgtcataaactgttcccgcgcatgactcgtttctttaatcatggctaaaacttcatccacacggtcatcatcaataccaatcataaaagtggtattacctgaacgtaggaagccccccgtcgttgagagcttcgtggcccgaacattggcttcaatgaactggctgctcaaccggttactgtccttatcttgaacgattgcaataattaatttcattggtcttctcctcccttggatgccacataagtcggtaactgtgacgccataatctctaaggcctgcgtcacaacttggtccaatggctgacttgcatcgacgcgcttgatacggtcaggatgatcagccagtaatctcaaatacgctgcttgcacccggtgatggaaacttaaggcttccacgtccaagcgattgatttcattttggcgatgttgttgaatgcggtttaatccaacggcagcatctacgtcaaaatacaacgttaaatctgcggttaaccccgcggtcgcgaactgattcatatcataaaccgcttgttccccaataccacgaccggccccctgataagcgaccgagctatcgatgtagcgatcacacaagacaagttggtcgttctgcaatgctggttgaatggtttggacgatatgttgtcgccgtgctgccgcatagagtaacgcttccgtacggtcgtccatcgccgtattatgacggtctaaaatgatttttcgaattgcttctgagatttgattcccgcccggttcacgcgtcacaactaagcgatcccctaattgtggctgtaatttggccacaatcgcgtttaaagctgacgttttgccggcaccgtctggcccttcaaaagtaactaattttcctgtcaacattcccaatcccatctattttcttatatgtagcaattgtacttgatttttgagtacctgtctaatacggttaccactagtgagggtactttttcacgatttttacgtgggtcggctactaccaattgtggttttgatgatttattcggtgaatggctaaaaagttattaggtagtactacccacgattgataaataccgattttagtttgttattcattagtagatacacatcttctattccaattgccgcacctagcatgtcttaatcacaatgcatgacagattaactggtaaaataatgctagggttctaaatcaaaaacgcacgccgtagatttacaaaaatcaacggcgtgcgtctttattttgaaacaagttatctcttaaatcactaacagtctatttatcaatgaccgagcgctgaatcgtctgcccatgaacttgacgtaaacgtgcttcacgatatagatataaatacttagcacgcgctaaggcggtctgcgtaactagttcactcgtattattatcatagaccgcttcttggttctgctttgcgcggtcccagtccaacttagcggcattcagggtcgacaacaactgttcatcaaaaacttccttgggatgcttgatcttctgtttacgtttaaacatggtggcacctccaattacatttcttggcgaccttcaactgctttgaataaggtcatttcatccgcatattgaatatcactaccaaccgacaagccgtgcgccaatcgggtcactttgattcccgccggcttaactagccgcgaaatgtacatcgctgttgcttcaccttcaggcgtggcattggtggcaataatgacttccttgatggcttcattttgctgtagccgtttcaataaactggcaatgttgatatcttccggacctttgccatcaatgggtgacaataccccatgtaagacgtgatacagcccgttgtattccttaatcttttccattgccatgacatccttggcctcttcaacaaccagaacggtgctttgatcacgcgacttatccttacaaatcacacacggatcatcttcggtgatattaccgcaaatactacaaaaatgcaggtcccgtttggccgcaatcagcgacttagcgaactcggtgacgtcatcaccgttcatatcaattgtataaaacgccagccgtgtcgcagtcttgccaccaatgccgggcaacttcatataactatcaatcaacttagcaattggttctggatactgcatgtacttacctcgtttttactgtaatcccttagtatattttcccatcgtactttgtgtctgttcatcgaccttagtcaacgcgtcgttcaccgcagcgacgactaagtcctgtaacatatccacatcatcaggatcaacagcatcagggttaatcgtaatatccttcatcttcttatcaccagtaaaagtgactttaaccatgtcgtctggcgccgcacccgtgaaggtttgttcatttaaagccgcttgttcggctgtcatttgcgcctgcatcttcttcatttgtttcatcatactttgcatattgcccattccacgcatcataattatcagttcctttcgtctttagtccggctgtacttcaactaaatcaccgaacatattcttagcttcttcaacgaccggttctttggccggtgcttgttgctctgatgttgcacctcctggctggtgagtggccaaataatccttacgaatttgtggccactgttctttaggcacacagacaatcttgggtgcctgtcccatcagccgatccaaaccatttccgagtgcatcgatcaaggtctggtcatcaatcgctttttgataaacaaacgcatagtcaaacgcaaccacaacaccctctgaactggccgcaactggttgggccacgtgcattagggcccgctgcgtcacactcaaaatgttcatcaaatcagtccaaacatcgcgcaccttaatgagatcattcttcgttgccgctcccagaataggataaatctgactgacattaaccttcttaacaaccgggccattactcgaccgcggcttagccggtgcgggtttagtgacactaccaccttgagaacgtaacgttttgacctcgctttgcaactgttcaacttgttgtgccagtttatgcacagtgggatcttcaggattgaccgttgccgcagctaccggttgaacggccgcctgaccatccaactgagctagcttgaccgtcaacacttctaaataaacgtcggggtgcgtcgtgaaccgcatttgttgttgaatatcgttcaacgtcttgaccatttggtacaggacttcagcatcgatttgcttggcaaatgcttcaaattgttgatcatcctcgcccatcgccacactatcgaccatttcaggggcctgttgatagagtaacacgtcacgcgtataactgatcaaatcttcaatgaaacggttcgcatctttaccttcttgtaagatttgtcgcatcgtctctagtgccggcttcgtatcatggtcggtgacctcactgacatagttagccagcaactgcttggtcacacttcccgtcaccattaacgcatcatccaacgtaaccgtgttatctccaaacgaaattacttgatccagaatacttaaagcatcccgcattccaccttcagcagccgctgcaatgacgcgtagcgctttttcatcataggtcacatccttctcattgaggatgtacaccatccgatcgtagctatccttagctgtaatccgccgaaaatcaaaccgttgcgtccgtgaaataatcgttaatggaatcttatggggctccgttgtcgctaagataaatataacgttagccgggggttcttctagcgttttgagcaacgcattaaacgcgccagtcgataacatatgaacttcatcaataatgtagactttatagtccgcttgcgttggagcatacttcgctttgtcccgaatatcacgaatctcttccacgccattattagaagccgcatcaatttcgatgacatcatttagttgccccttggtaatcgccgtacaagtctcacattcattgcaaggttccccatcaacaagatggtgacagttaattgccttggcaaaaatctttgctgccgacgttttcccagttccccggggaccggtaaacagatacgcatgactcgtctggtgggtcataatggcattttttagtgtctgggtaatcatctgttgcccgacaatctcatcaaagcgttggggacgccaaacccgatatagtgcccgatacatgcgattcttcctttcttacatcagtcatactttggttatcattatttattataagccattgtttaaacgtcctgaacagttagcttcctggttgtgctgcttccactaacgatcagtgtcagttatgcaaattaagcatctaagcgcacttgccaacgagtcgatgcccaggcctttaaccacctttgttaggcgtttggttattccttcaacaagcagtggctttaactatcagcctgaaaagcatcacccaaataacgtattactactataataataggtaaataaaaataaaccaacctatcagcacgttcaaaactagcactcaatatttaatttaaataaaaagctctcaaccgaatggctaagagctgttacatttcataaaaacaaaaggcacaagatgaagcaaacttagtgctgcttccttccggacctgacacgattcgtaaatccacccttgccttttggccttgcggcaaatactataatacatgatttgcgccacaattaccagccatcggcctaatttttttcagcagcttcacgtcgtgcttttttagccgcctttttccgtttacgaatcccacggaagaagttttccaacatctcgccggccggacgtgccaagatgcgttcatgaaccgttacttgatgatttaaccgggtatcatccatcacctgatacaaactacgaacggcgccagccttgggatcacgggcaccaaagtagagttcaggtagccgtgcattaataatagccccactacacatcaaacatggttccaaggtgacatatagctgacaatcggctaatcgccaactatgcaaatattcgcaagcttcctgaatcgcaataatttccgcgtgcatcgttgcatcctgaccatgctcccgtaaattgtgaccacggccaataatttcaccctggtgaacgatcacggccccaatcggcacttcgccaattaagtaggccatccgcgcttcatgtaatgcttcttgcatccagtcttccgctgttggttccgtcacgactgacatagatgttggcaattgtgttaacatctatttttatatcatgccggcttagctcagttggtagagcatcggtatcgtaaaccgagggtcatcagttcgactctggtagccggcacttgtgaggtgggacgtggttctcgcctttttatttttaaatagacataaaatgattggcagctttgcgcaaacgcaaagctgcttttttgatataagaatgttagctatttgaatgccgaagtatcaaaatgatcgtaagggcttagtaagatgatgcctattttcgccactgcttttttaggtatgcttagcatatcaatcttgcggtttatcataattagtcgcaataactgtaaattacatgctacgaacaatcatagccattttaatagcggtactttattgttgataatttcagttttgtttttttgtttaattagatttttaataccaattgcgtattttcagcatttgaatgctattaattattttatattaaattagaatttagtgttaattttagaaagctaaaagccttataaaatgtcctatcaactagttttgggtgctataaaaggatttaagactatttatgtatggtggatattaatttaattaatggttattagattagaaaacggttagtgctattgttgattaagattaaggctagtataatagttattatgtttaattaagaaacaaaacttgttacttttaaacgaaatacaaactggttaagaagtttggaggaatctctattggataaggaacaaaagctggatcggtcgttctttggccaaccccgtggcttacggacgttgttcttcactgaaatgtgggaacgattcagttactacgggatgcgtgcgctactgatctattacatgtactacagtgtcgctaaaggtggtcttggatttgaccaagtcaccgcagcatccattatgtcaatctattcggccttagtttacgtttctagtgtcctcggtggctttctaagtgaccgtgtctggggtagccgtaagaccgtctttattggtggggtcttcatcatgttaggccacatcgtgttatcaacgccatttggagttggtgcactatttgtttcaatcgcacttattgtcattgggactgggttattaaagccaaacgtctctgacatggttggtcaattgtatacagtggaagatacacgtcgggatgcaggttttagtattttcgtcttcgggattaacttaggttcattggttgcaccagccttagttggtcggatcggcttaaatgttaacttccacttaggcttctccttagctgcgattgggatgttctttggtctattgcaatactactttgatggtaagaagaatttaagttctgctagcctctatccaactgatccattggaacccggtgatttgaaaaaaatcatgcggtggacaatcttaggaatcgttgggattgggttgattctactattaatgcaattaatgaatgctcttacgttagcaaatgttattagtttaattagtacgcttgttatcttgacaccaatcgtttactttattttgatgttaacgtctgacaagactaatgcaacagaacgttcacgtgttcgggcttatatcccattgtttattgccgctgctttattctgggcaattgaagaacagggttcgtccgtacttgcgttatttgcagctaaccgggttaatttggatcttggttttacccatctagctgcttctgatttccaaatgctaaacccattgttcatcatgatttatacaacaccattcgtgtggttgtggactaagtggggtaaaaaacaacctagttcaccaactaaatttgcgattgggttgctattcgctggggcttcttacctagtgatggctgtacctggggcgctctttggaactgcagggaaggttagtccatggtggttagttgccagttgggcagtcgttgaaattgctgaaatgttgatttcaccaattggtttatcagttaccaccaagcttgcaccaaaggcttttgcttctcagatgatgagtatgtggttcctaactgattcagttggtagtgcacttaatgcacagattgtccgtttctactcgacgcaaaccgaagtgccatattttgcgattaccgggattgttagtgtcgttttagggattatcctctttatgatggtgccaatgattaaacggtcgatgcaaggcattcgctaaattgaatatttactcgaagatatgttatcttagtggtagcatatcttttttgttttggaggggttgaccatcgtacgaattgctttcagtagtgataatcattttgatgttaatcgagtggatgcgactgcgatgatgcgatctcaggcgacctatcttttacagaatggtgttcagatttatttgattgctggcgatctttttaatgactttcagcgtagtcagcagtttgtcgtcgatttacaggccctattaggcgcacagacgcgtgtttactggattgcaggtaatcatgacatggtccatggcatttcgtttgacgagcttgaaacagggcattttgatggctacctgcataaccggtatatcgatatttctggtacagattggcgcgtgattggacataacggttggtatgactatcagtatgctgcccaggtccctgatacgactgcggccgacttcttacactggaagaatgcgttttggatcgaccgggctattaaacagccgatgagcgatcaggagcggactgatttaatgttcaaccaagtaaaagcgcagcttaacttggctgctgtggatcacaagcaagttatttttatgacgcactttgttccccggatcgattatttgcgtttttctgatgataatcggttttggaatatggctaacgcgttaatgggaacgccccggttaggacaactgttggatcagtttaacgtggcgcacgttttatttggtcatttgcacgtccatccgcaaccgcgggtgtttggtcagaccacctattatgaccaagcagtgggctatggactcaagcgtatcaatgaatggcaagccaataattttatggcggagtggtatcaagatacgcaaattctggatttgaaataaaaactgaaaaaaactttgaaaaaagtcttgattttttattcaaaattatgtattctaatatagttgaatgatttacggaggggtagcgaagtctggctaaacgcggcggactgtaaatccgctccttcgggttcggtggttcgaatccactcccctccatttcattattgggctatagccaagtggtaaggcaacgggttttgatcccgtgatgcgctggttcgaacccagctagcccaattgttacgcctttcgtcgttaatcaggtcttaggatcttgatgtaacgacttttttattggcttaaatttatcttaatatcggcaggtagtgccacttcgtgaagaatgcgtaacggattcttcatgaagtggatttttttgtctcggtctgtttatttgccatcatcaataataatgtgatatgttttagtattctatttggggcacgatccagatgggataggaggtctggtcaatgaatttatttattccgtaagtacacggaagaggttaatggctggcattgttaattttaaaaatacgtactagttaacgcgtcatgacggccatcacaattattatgagtcgttcttataaaagcacaccaatttttaaagcacatatgggttatggaaagaagcgcgctagccgtgctgttcgaaatcgtatgaatcgtggtgaatttgatgatttgccggctaattcgcatgcctggtataaacgatgttatgagcagtatgatgttgtcgattattgctccagagagacttattcgcaagttcaacttgagctggagacgatgcgattagagattactcgtaacggtgggattattcgaagaatcccacaacatctggttgttacgtatacttttgatccggtgatatctgatattgtgcacatgcagcgaacggaagaactaattcctgcgcaagatgtccaaatgtttgtaggtatttttgaacagtggtgtcgggagcgtcgcaactgctgggccaaggcttattatcgaaaataagtcgtattggaacttgatctatgagatttggttgaagaggctacgtatgcgtacccttggttgtcccactaccagccccaactagttgactgaataaatcaaattttccacagaactgttatcaaatgcagtaacggcaggctgtccagcgtcgcaataatgcttgggcagctttttgcatggcccatatctggatgcaaaggcatttacctgtcagagatgacgtggttattaagtatatgactagcagtcagttattcagaattataagatgtttattcaatcgaacctcgaaaattgagtttgttagcgttaagcttaatttaagaaatcataccatcatgaataacgtaagcgaccatgatgatgaccaaggaggatttgaaatggcggtaactaaaattgatttaaaaaccacgatgacttaccgggagcatgcaattactagtaaatcatttgctcgaaaattagggattgaactgccgtttgcgatgtacgcaatggcggcgggtgaaagtattagtgctgaacaatccacgctgacccgcttatttgaggttgttgatggtactttgaccgtccgtttggcgacggagaccgaccaagaagtgcatgcgggcgagattttattggtgccagctcatacggtccatacgttggtcgctgagcagccgtgccagtttattcaattagaaacgaaataggccttaatagcgagatgcggaggaattcaaatgagtttaattaacaaaattgatcatgctaaggtcctcaatttaactgaacaaattccactggatgatgatcaagttaatagccggacactggttcaacgggatgatttaagtatgacgctattttcagtcgcaaccgaccaagagattggcggccattctgcccagggcgatgcgatggtcaatattttaagtggagaagcggaaattacgattgaaggcaccatttatcatttaactgcgggacaatcgatcgtgattcctaaggatgcccggcacgcgttatatgccgttcaaggatttcagatgttattggtggtcgttaaacccgactaatgcacgtggttatcgatgagacggagggagtaatatgccgctgtatacgtttattggtgatattcatagtgccgcggatgatctgacagttttattagccgatcctgaagttaccgcgacgcgcttgattttcttgggcgattatattgatggtacggcggcacgctattttggtcatgccaccgagtcagctccgttggcgccgctaaaagtactgacgatggttagaaaacgggtacgggaatacggcgatgtggctttacttggcttggcaatcatgatgaattttggctacggacagctcatggtgatgacaatgccaccgcaacttgggtgttgaacggtggtcaccggacctggcgcaaattagggatttactcctccaatcccaatcatgttcggcgggcattaaatggtgcgctattaaagccggatactgatttcttagcacatttgccgctgatgtggcaacatggtcggttactggctatgcacgcgggtgttaactggcaatacccattaacacaacaaacaacgactgacctactgtggattcgggatgactattatgatgacttcacgactggcagtcaccgttggcatcggaacttattcaataaagtcatcattactggtcatacgccggtgcagaccttgactggttcacacactggttatttaaagatgcaggcagatgcgcaagacgttccacgatatctaattgatgcaggcagtcgttcaggcctgtttgatggtggaatttgtgcgttaacgctgacggtcgatggtgaatttgtcagggcgaaacgcgtgatcaagggtcaccgctacgatggtcagcaaatcgtcactccggccatgttggtggatcaggcgcactaagtatcactaaacatctcagagatagaacgtaaaaggagcaggctcacatgatattgagactgctccttttatgatgtcacgctagttactggttttcgcactatttcaagttgattggtttgcaagttctcactgaatcgttactcagcgtaactgaattataggtgtaaatagaaccagccaccaaggcctaaaatgaacaggccaagtccattgagggccgtaaacacgatcaaaaaatggtggagtggttgttcatcattgaagggcaacaattgttttaaggcaagcagatttgctagtgaggccaccaatgaccccagaccgccgatgttgacgcctaaaaatagcgctgataaatggggcgtgaaattcgctagtaagatggtggctggaacattgctgatgacttggctagtaattagtccagtaatatagacactgggggctgtctgagtcaattggttgagccaatgcgttattgcgggattatgactgatggcgctaacgaagatgaagaagcagataaaggttaagagtagtgcgtaatcgacgtactgaaagacgcgtcggttaatcatgaggcctacgacaatcgttccgataataactagtgaaatgggcaccaaattaaaaatgccaagcataatgaaactgagcaggccgcccgcaagcccgatttgactgcgagaaatgggcgtagatttggttggtgttacagttagcgacaagtgaggtaaccgccagcttaaggcgactaataaagctagactagcaagcattaacggggtcgataatttaaaaaacgtgaatagattaacgtgatagaacgtgaccaaaaataaattttggggattgccaatgggcgtaaatgcgctaccaagattggctgccatgataattaaagtcgttgggtaggcaatggccaggtgctgccgccgggcgagtgtgagaaagattggaactaacgttaggatcgcaacgtcgttagttaaaatcattgagccaccaaaggccagtaagatgaataattgacacatttgacgggtatcgtgtgatttaactaagagccagtcccttaaagtatcaagcaaatgcatcgcgcgaagcaattgaacacagatcatgagtgcaaataaggtgccgatggtggtccaattaattgctgccagccatggtgtcccaataaacaaacttaaaccagcacaaattaatgcaataataaaaattttgtcgtgtagcgtgcgacgaacgactgtcatcatggtaaacgaccccctcagtagtcagttaagtagttttaacttaaacaaactcgttggtaaatgtaaactgatagacacttttaaggtagcagtatagcgacccaaataaaaaccagttcaaagttatggtcaactttgaactggttagtggttgtttaaaatggtggttagccggcttggttaatgtgcgtctagtttatcttgctgggcactttgaccaaaaaaccacaaataggcaccgtataatgcgtttgcgagcatcaccagctgcaatgctaacattgaggcggctgcaggactgaagccttttaattggttgaaccagataataacgttaatcacgtcgagtgtgatccacgcaacccattgggaacgataaccgttgaccatgaggacactaccgacaatcccaagtggtaacagggtcgcgtccaggtagatttggttaccgttaagttgtttactaaagtgtaagacaatggcgtagacgagtacggctaacgcgaaccaggcacaaccggctaatttgctcaatttacgaccagtcagttcgctggcgtcgggttgcgctgccattttacgatgccagacggtgatgccgacaaattgcatgataaggtaaaatgattgcgacgcaatgtcaccaatcagccgattggtgatggccgtagtaagccaagccgcacaagcaataatgccccagctatagttcgtcagtcgcccttgatcaaccagaattaagttaatcacgaccgtaatcccggtcaataggccaatccagccatgtaggctgtaatcgcggcccagaataaaaccaatgatggtcacgattagcatcgtgctcatcatcaacttagtggtgcggcgaagcgtctttaattcattaagtccccgttgccagctgaagacggcgcgcatggccgtgggcagactagtgatgtcttgctggcattgttgcagcagggttgataaggtgagtcggaaatggttgttctggttcatagtgaaacactccttagttgtttttagacagccgtgttcggaagcaacgctgtgtttgattgctgtttacattagcttgttcaggcgggcctgtcaacgagccacgcgcatattgaaggccgattattaatagattaatcaattggtttcagtattgataagcaatcaccttaatagagtggctcgtgatatttatttgttgatagtgaaagttgaactgaaaaaagtgattaattacccacagtttcacaaatattggtatagtagaagagtaagcgggaatgtctgtttaatcctgcctagccgttaatcggttagtggttaatgatataaattataagtcagaggagcgttttacggatgaaaatcggattcattggtgccggtaacatgggccgcgcgattattgatgggtggttaaaacaacaagcggtcgtcccagcagatatttatattcacagtgcccatgccgcgagttatcaaccttatgcgcaaaaaaatgggctacaggcctgtgacactaatttggccgtggcacaagctgctgacgttatcgttttggcagttaagccgaacattgcgttggccgcattaaaagaagttcaagcagccttaacgggcaagtgggttattacaatggtatcagggttgagtttggccgattatgccacggttgtccctgatctccccgttctgagaatcatgccgaatgtgaacgtggcgattggtggcgggatgacggcgttggttggtaatgatgccttaacaccagagcaatatgcggctgggcaacaattattcgatgcgattggtgccacgagtgccatcgctgagaaagattttccaactttttcagccttagcaggtagttcgccggcctacatctatttctttattgacgcgatggcccgcgcaggcgtcaagcacggtttgagcaaggatgcagcgactaagattgcggcgcaggccacgctgggcagtgcgcagaatgttttagcttctgataaaattccgtttgacctgatcgatcaagtttcttcacctggtggcacgacggttgctggattactggccatggaagaggccggctttatgaccgcagtggtgaagggaattgatgcaacgattgcgaaggaacttggcgaatcttaaattacttggtgctggtggttgcaagtttggtctataccgattataattaaaccagataaatccaaggaggaattgttcatgagcaaagtgttaaaacatgccatcatttatactggtctagaaaagatcgatgacggctacattcgtttcggtaaggaaattgaagcggttggtccaatggatgactacgtggcccaacccgatgatgatatcgaatttgtgagtggcaaaacgattgtaccgggcttcattgatgttcatagccatggtggttatagttttgattcaatggacgggaatccagctgaaattaacgaaatggttaatgatatggttgcccgcgaaggtattacgtcatacttctgtacgaccatgacgcaatccaacgaaaacttagaccattcgatggccggtattaacaaggccgccgatgaaaatccggttatccaaggggttcatttggaaggcccattcatttcggcgacgtttaagggtgcccaacctgaaaagtacattaagaatcctaacgttgacttattagacaactggaacaagttgtcgggtggtcgggttaagttgattacttacgcgccggaagatcctggttcgcgtgaatttgaaaagtactgcttggaaaatggcattgtgccttcagtgggccacagtaacgcgactcgtgaacaattattagcaagtaaagcaactcacgtgacgcatttatacaacgcgcaacgtgaattcaagcaccgtgaaccaggtgttactggtcatgccatgcttgaaaacaacatgtactgtgaattgatctgtgatgggttccatatcgtgcctgacatgatcaagctcgcttacgaacaaaagggcgttgaccggatcgaattggtgactgattcaatgcgtgccaagggtgaacccgacggtatcagtgaattaggtggtcaaaaagtgattgttaaggatggtcaagcacgtcttgaagaaggtaacttggctggttctgtcctgacattcattaatgccttcaagaacattcagaagttcaccggttgcggcattgctgaagcggttaagatggcttctgtcaaccaagcacgtgaatttgggttgactaagaaaggaacattggaagccggtaaagatgctgatatcaacatcttagatggcaatcaagatttagtcgcaacatatagctacggtaaaaaagcagctaaataaattagaagtaagggatgagtaccatgagttcgccaatttatattcaaatccacaaccaaattaagcaggcgattgaagcaggtcggtgggccgttggtgaccggattccgtctgagcgggagctggctacacagttcgatgttagtcggatgacccttcgacaagcaatccagacattggttgacgaaggaatattagagcggcgagtcggtgccggcacgtttgtcgcgaatcagaaggtccaagaaaaaatgtccggtgtcaccagttttactgatctaatgctggcccagggtaaggtcccatcaagtaagacgatttcatatcacgtgacgagcccgtcgctatctgagagcgaaaagttggcgttaggcgccaacgaacaagttctacggatggaacgaattcgctatggtgatgatgtgccaatttgttttgaggtcgcaacagttccagaacgactcgtcaagcagttcaccaaggacgaaattacgagttcgttgtatcggacgttagaagagaaggcaagtttagtgcctggtaaggctcaacagacggtttcggcgatgtctgcttctgagcgtatcgcggactacttgtcagtccggcgtggcgatgcgttgctacggttacggcagatttcgtatttgcaaaccggcgaaccgtttgaatacgtgcggacccagtacgttggtaaccggtttgagttttatcttgaaaaataaccagtcggtcgggtgctgggcacctgattagagtggtgataccaaaaatagctcacctaggatgttattctaggtgagctatttttggattcatgactgaagactgggtacacgcacaaaagcaattgtcatcgtaacgcagtggcttataactggtaatgattgccagttaatgggcttgctggcgcgctatttttttaactaaccgcaagtagcggggtaacacgagcatccgcttgaaacgacttggttcttgaatcagacggtagagccattcaacgtggtgtttttgccaaaataacggcgcccgcttaaccgcgcctgcaattacgtcgaagctacccccgacacccatccagagcgcatcgaggcgttggcggtgttcggcgatgaaaaattcctgcttaggaaaaccagtggctacgaagaccatatcgggttgcgcggccacgatttggtcgacaacggtttgttcgtcgtcataatagccatcacgggcacccgcgacaacgatgccgggataatctcgttgaacgatcgtggtcacttgctttaacacggccggcttggcacctaacaaaaagatccgttggtgctgttggctaccccattctagtagtgttaaaagggtgtcatagccggtgatccgttcggggagtggtgtgccaagaatctgggccccctgaatgacgccaatgccgtctggcgtgatatagtccgcttgcgttaacacctgttggtaatcggggtgttcacgagcgtacattaagatctcggggttagcggtcaccacaaagcgattgcgatgcgcgagaatatcggtttgaagttgctgaacaaaaccagcgttagttgtcttgataaacggcacgtttaagatgttaaccgtgtcaaaagggactgacataagcgacctcactttctaatcataattaaagtataggtaaatcaaggaattctgcaactttttggatgcttaagcgcattcttttataaaaaatgctaaaataagcttaacttactgtaaacacggttattacctacgaaatggagaattatactcatgacgcaaatctatccggatgatagttttaccttgcatacggatgcttatcaaattaatatgatccaaacctactgggaacaaggtattcacaacaaacatgcggtgtttgaagtgttctttcgtaagatgccgttccaaaatgggtacgcggtatttgcgggtctggaacgagttgttaattatatcaatcatttacattttactgcaactgacatcgcatatttacgtgaactgggtggctactcagacggttttctagattatttagcgaatttcaaatttgatgcgacgattcgtgcggttcgtgaaggagacttggtctttaataatgaaccgttgttacaagtcgaaggaccactggccacttgtcagttaattgaaacggcactactcaatattatcaattatcaaacgctgattgcgactaaagcggcgcgcattaagtcggttgtcggtgaagatggcttgctagaattcggtactcggcgggcgcaggagtttgatgcggccatctggggaacccgggcggcttatattggtggctttgacgcgacgagtaacgtgcgggctggcaaaatttttggtattccgattagcgggacccatgcgcatgcgctcgtgcagacttatcgaaacgattatcaagctttcaaggcctatgcggagacccatcatgactgtgtctttctagtggatacgtatgatacgttacgtagcggggtgccgagtgcgattcgagtggctaaggaaatgggtgataaaatcaatttccaaggggttcgtatcgatagtggcgatatggcttacttatcaaaacgcgtgcgtgaacagctagacgaagctggttttccggatgccaagatttatgcgtcaaatgatttggacgaaaaaacgatccaaaacttgaagatgcaaggtgctaaaattagtgtctggggtgttgggacgaagctaatcacggcctttgaccaacccgcgttaggggccgtgtacaagatggtttcgatcgagaatgatcatcatcagatggttgatacgatcaaactttcaaataacgcggaaaaggtctcaacgcctggtcaaaaacaagtttggcggattacgaagcgtgcggatggcaagtcggaaggtgactatgtgacgttgtacgatgaagatccgcgcaacgaagaatcaatttacatgttccatccaagctatacgtatattaataagacggtcagtgactttgatgcgcgaccactattggttcccatctatgaccgcggtcaacaagtttatactttaccaacgttagatgaaatcaaggagtattcatttgaaagtctagatgcactttgggacgaatacaaacgggatttaaaccctcaggattacccggtcgacttgtcacaaaaactttatgatcataaaatgaatattattaacacggtcagagaccacgttaaccataaagatgaggaggaagcttactaatgcggccattacaagctgagattattaaagcgttacacgttgcaccaacgattgatccagaagttgagattcgtcgaagtattgattttttgaaggcttatttaactaaaaatacctttttgaagacctatgtgcttggcatctctggcggtcaagattccacgttagctggaaaattgacggagatggccattaccgaaatgcggcaggaaacgggtgatgatcgctatcaattcatcgcagtccggttaccatatggcaatcaagcggatgaagcggatgcgatggcagcgattgattttatgcaagccgacgtgacggatcgggtggatattcaaccggctacggatgccatggtgactgcattggaagctaaccaattgacgattcatgatttcaacaagggcaatattaaagcgcgccaacgcatgatcgtgcaatatgggattgccggtgaaatgcacggtgctgtcgtgggaaccgaccatgcagccgaagctgttactggtttttataccaagtacggtgacggtggtgcggatattgtgccactatggcgattgaacaagcgtcaaggtaaacaaatgctggccgctttagatgcgcccaagcatttgtatgacaaagtcccgaccgctgacttggaagaagatcggccagcattacctgatgaagtcgcgttaggtgttcggtacgacgacatcgacgattacttggaaggccggacggtcagcgatgctgcggccgaaaagattgaggcgtggtacttaaagactgcccacaaacggcacgcggccatcactgtgtttgatgatttttggaaataagctagttagctgataatcgattaggattacggctaacctaattaaaaaggcgacttgaagattattcagcttcaggtcgcttttttgcatagtcacataattttatggtgactaccgtaatattggtgggattggtggaaaagcggtagaatggtttaaaatatgtaaacgcttaatgtgagaatatccgagtgctgtggcgaatgcagaggtagtcaaagcgattattttgctagacagctcccatggaatctggtattcttacgatacaatcataagggagtaactagcagaaatattctgcggcaatatcgtcagcaagaagccaatccggtattgtcttaaatagtgagacttatgtatgttcacacaattttgcgtgcatacatgagtctcattttctatctggagatcagttagggagtggggctcggatgccagaaaaggagcttacgatgagtacaaaaccaaagtatcaacaagcgttatccgccgtttatgaggaactaggcactgatgaacacggcttacagcaaagtgctgcgacgcaacggttagaacaatatgggccgaatgcgttgaatcagcaaaaaacgacttccttgttgcaaaaatttattgcgcagttcaaggatttcatgattatcgtcctgttagtggctgccttgattgccgcctttactggggaagccgtcgatgccgttatcatcttattggtggtggtattaaatgcgattttcggtgtcttccaggaatcgaaagcggaagaggccatcaacgcgttgaaggaaatgtcagcgccggacgcgactgttttacgggatggtcagctgcaaacggtcaagagtgacgcgttggttcccggggatgttgtgtcgctagaagccggggatatcgttcccgcggatttacgattaattgagagtgcgtcattgaaggttgaagaatcggcgctgacgggtgaatctgtcccagttgagaagcaggcggagatgattgccgatggggagttaccaatcggagaccggttaaacatggcgtacatgaatagtaacgtgacgtatggtcgggccactgggattgtggtggcgactgggatgcagaccgaagttggtcggattgccggcatgattgaagcggccgatgagacgaccacaccactgcaagcgaacttgacacagttaggtaagtcgctgacgattttaatcttagttattgccgcagtggtatttggtatcggaatgctgcgcggtcaagagagtttgatcaacatgttattgacggcgatttcgttagccgtagccgcaattccagaagggttgccggcaatcgttacgatcacgttagcgttaggaacccagcggatggccaaacggcatgcgttagtacgaaaattacccgcagttgaaacgttgggaagtaccgatattattgcctctgataagaccggaacgttgacgcaaaacaaaatgaccgttgaaaagttggtcgtcaaccaggaactggtggacgcgcgcgctactgaattgccgcttgatagccatttagcccaagtgatgattttaagtaatgatacaaagatcatgccggatgggttagcaggtgacccaacggaaacagcgttgattcaatataatttggatcagggttatccagtcgatcagttgttgacggaccgccccagagtgacagaagtcccctttgattcggaacgtaaattgatgtcgacggtgcaccccttagaagatggtcgcttcttagtagccgtcaagggggctcctgatgaattactcaaacgggtcactcagattgaaagtaacggtgacgctcagccgttaaccaagacaagccgtgaccagattctagctgttaatcatgaattggcaacgcaagccttacgggtcttagcatttgcttataaagtgatcaccacggttccgacgactgttaatacggaaacgttagaaaatgacctggtctttgccgggatggtcggcatgattgatccggaacggccagaagttgagcaagccgttgcagaagctaaatcagctggaattcggccgttgatgatcacgggtgaccaccgtgataccgccgaagcgattgccgtccgtcttggtatcattaacgctggcgaagatgacgctgtgattactggtgccgagttagatgcaatgagtgatgcggaattcggcaaaaaggtcggcgattactcggtgtatgcccgggtggcacctgaacacaaagttcgaatcgtgaacgcatggcaaaaacgaggcaaagttgttgctatgactggtgatggggtcaacgatgcgcccgccttgaaggccgctgatatcggtattggtatgggaatcactgggacggaagtttccaagggggctagtgacatggtcttggctgatgataacttcgccacgatcgtggttgctgtcgaggaaggccgaaaagtgttcgccaatattcaaaaggcgattcagtaccttttgtcagcgaacttaggggaagtcttaaccttgttcgtgatgacgatgttgggctggcaaatcttggcaccagtgcatatcttatggatcaatttagtgaccgataccttgccagcaattgccttaggcgttgaaccaactgaaaagaacattatgcagcataaaccgcgcgggagaaattctaatttcttctcaggtggggtcttcagcagtattatttatcaagggctactggaaggtggcattacgttgctcgtgtactggttagctttgacgtatccggttcacgcaacggcctcattagctcatgctgatgcgttaacgatggctttcgcgacccttggcttgattcagttgttccacgcgtttaattctaaatccattcatgaatcgttgtttacggtcggcttgttccgaaacaagttctttaattgggcgattctaattgcatttgtgatgctggcgatgacaatcgtcgttcccggtctgaatgggttattccacgtgagtcacttggatgcttaccaatggggaatcgtggccttagcttccttatcgatggtcgtgattgttgaaattgttaagttcttccaacgtcgacacatgcggcgcgcataacccatccattaggggtaaaataaggctaactaatttaaagaaaagagtttgtacatgaaaaaagcaacgattcaaacgtatatgccagtactgtctaaagttatcgaaagtactgaaaaaatgggggaagaattaaacccatcttttgaaaaactacgtcaggccattgataatgacgcagttgccaaaatggttccagctgaattcaatgatattcagatggaatttagcgatggtactgaacagtatcaacaaaatttggcacagttgaaaaaagttgcggtacccgcacggttaatggggcggcaccgtaatttgttagcagcatacgaagcctacacgaatgcgtgtgcggccatgacggctagcatgaacatcgacgatcaaacgattgatgtggctgcttttaatcaggctgaaacggatcaagagactgaaatgggccgcgtttcaaataacgtgcaacggatcatgaatacagtcatgtaggagcgctaatctgggtgattggatttagcacactaataaaacgctcggtaacgtttatgcgttgccgagcgttttattgttggttgcggggcagccaactgtgcggccgcgccgtgctcgtttagcctaatgggctggttttttccagctcacaaccaatgtgtgaacagtatcggtaatggcttcgattggtagtgacagtcaacgacaattttcagatggtcattcggcgcggaaacttgggtaaaacgcgtataatataatgtaatgagattaaaagattgggtgaaataatggataatcagattttaacgttagttaatcaaacgctgacgaagtttaaaccgcaacagatcaaagcggttctcggactcatggacgaaggcaacaccgttccgtttatcgcacggtatcgaaaggaacgtaccggtaacttagatgaagttgaaattcgcgaaattaaagataactatgatcggcttgcgagtctcgagagtcgtaaggcagatgtgatgaagttgattgctgaacaagatcacttgacgccggctttaaagcaagccattgaaaaagctgacaagttgcaagatgtcgaagatttgtacttaccgtacaaacagaagcgacgtacgaaggcaacgattgcgaaagatgctggactggagccgttagcagcttggttattacgttttccggcaagtggtattcaggaacacgcggcgcagtttgtgaacgaagcgcaggacatcacagacgcgaataccgcgttagctggagctcacgaaatcttggctgaggcctttggtgataatgctggtttacgaaactgggtccggaattatacgcgtgaccggggcttactagtcgcaaaagtgaaacccaagggtaaagcagccgatgaacaaggtgtttaccaacagtattatgattttaatagtcccatcaagcagatggtaccgtaccgggtactggctatcaaccgtggggaagccgaaaaagtattgaaagtcagcattgatgttgatcgtgctggaattgaccggtattgtcattttcgctttattggtcagcaccacggcccagcgattgaactagtagaagctgcttatcaggatgcctacaaacgctttattggcccagccatcgaacgtgaacttcgcaatgaattgagtgcggctgccaatgaacaggccatcaaagtctttggcgataatttgtaccacttattaatgcaggcaccattaaaaggtcgcgtggtattagggttcgaccctgcttaccggacggggtgtaaattagccgtgatggacgcgaatggtaagttcttagataagctcgtgatttatccacacaaaccagctccaactgccaaacgggaagctgctgcgggtgagtttaaagcctttttggagaagtatcatgttgaaatgattgcgattggtaacgggacggcttcccgcgaatccgaggagtttgtggcacaggtattgaagactatgacccgaccggtttattatgtcatcgtgaacgaagccggggcttccgtgtactctgctagtgctaaggcgcgtgctgaatttcctgagctacacgttgaacaacgtagtgcgatcagtatcggccggcgactacaagacccactggcagaattgatcaaaatcgatccgaagtcagtgggagtggggcaataccagcacgatgtgccccagaaggaattgacaacgcagctggatacggtgattgagaccgcggttaaccaagttggggtcaatttgaataccgctagttcggagctattgacgcatatttcggggctatccagcacgattgcccaaaatgtgattacttatcgggatgaaaatggcgagttcacgagccgaccacaattgaaaaaagtgccgcggttgggaccgaaagcttatgaacaagcggtcggcttcctgcgaatcattgacggcaagaatgtttttgataacacggatattcatccagaaagttatcctgcagccaaagcgttattggcagcggctggattaaagacgacggacgttgggacgactaaagcccaacagttgaatcaattagatttagcgcaacttgcgaccagcaccagtgtcggtgaactgaccttaaaggatattattagtagtttgcaaaagcccgggcgtgatgttcgtgatacgatgcccgcaccgttactccggcaagacgttttaaagatgagtgatctaaaaccaggaatgcagttgcaaggaaccgtacgcaacgtggtcgactttggggcgtttgtggatattggtgtcaagcaagatggcctcgtacatgtctccaaactaacggataagttcttgaaagatccgcgtcaggcggtggcagttggcgacatcgtaacggtgtgggtcgaagaagttgatgaacagcggcagcgcattgctttgacgatgattacaccggctgaagcataatgactgatttagagttacagcagctcgttgcgaccatttccatgcgtgattttcaccgtccgttccagcaccgcgcttgttttaatgctcggttacgaacgacgggtggtcgttatcagttggcctcgcatgatattgatatcaatccgaagatgctgactgattttgatgaggccaccttgattggcgtcatcaagcatgaattgtgccattatcatttacatttgactaagcggggatatcggcatcgtgatgcagactttaaacgattactcgcgcaagtgggtggctcgcgctatgcaccagcgccgaagcaggcgacggcccgaccgtatcggtatatttatgaatgccaacggtgtggccagcggtattaccgcaagcgccgcatggacactcgccgctatacgtgtggtcgttgtcaggggccaattaaattagtctgaaaaggtttgctaaagtggtacgcttccgatagaattagcttaactattgatatggagggattaagatggaaacgattaaaattggtgtggtcggactaggcacagtcgggaccggcgttgtaaaaatgcttcaagcgcatcaggaaaagatttcagaaattaccggtcgtaagttggaactagcctgcgtagttgtccacaacttgaaaaagcacgaacaagttgatttgggggacgttcagatgaccgaccaaatcgcgaccctgcttgatgatccgtccattcaaattatggtcgaagtgatgggttcaattcatccggcgaaggaatatattacgcaagccttgcaagctggcaaacacgtggtgacggccaataaggacttgattgcgcaatatggccgggagttggttcagattgctcgtgaaaatcatcgcgacttattctatgaagctagtgttgctggtgggattccaattttacggacgattgataatagtttcgccgctgaccggattcaacgggtcatgggaatcgtcaacgggaccactaattacatcatgacgcagatgctgactaagcattggtcgtatgatcaagccttgagctcagcacaagacttggggtttgccgaaagtgatcccactaatgatgtcgaaggccttgatgcggcattcaagatgattattttaacgcagtttgcctttgggatgagtctttccctcgaccacgttcaagttcagggaattacgaaaatcagcccagaggatattgcggaagctcaccagcttgggtatacgattaaattactcgggattgcggaagaaattgacgatcgcattgcggtatcagtcggacctgtgctcgtttctgatcaacatccacttgccacggtacaaaatgagaataatgctgtaatggtaacgggaacggctgtggggaacacgatgttttacggtcccggcgctggagaactcccgaccgccaacagtgtgctgagtgatattacaacggttgcgaaaaatattgcgttgaatacgactggtaacacgtttaactcttatcgccaggagactgtcttagcaacgcctgaagatgttgtgtatcctcactttattgccttgaagatgcgtgatgtgccggggatgatgatgaaattgacggcgattatgacccgcgcagaagtttcatttagtcgaatcattcaaaatcaattaggtgacggcaacgctcgtgttgtgatcattacccatgccatgaatgatcaacagttagcagatatcactcgtgaaatcggtgaacaagagaatatgcaactattagcgagttataaagttttaaagaatgcgtaggtgaggacatgttaacgatttcggttccggcgacttccgctaatcttggtcccggttttgattcaatcggtctggcgctagacatgcaattaacgctacaagtgttgcaacctagtgatcattggcagattgaccatccctttggggcggatgtgccgacggatgaacgcaacttaattattaaaacggcgttgcatttggtaccagatttacaaccacagcatttacagatggcttcaaaaatcccgttagcgcgcggattgggtagtagctcgacggccattgtagccggcttagtgctggcaaacgaattgaccggcgcaacgcgctcttctgctgagctactggaagttgccactcaactggagggtcatccagataacgttgcaccagccctattaggaggcttggttgtggcgacgaacactgatggacgcgtccgtgcggtgaagttaccgttaccgatgctttttgcaagtgtctacgtgcctaacgaaccgctattgacgaccgccagtcgccaagccttaccaactgaattggcgtaccaccaagccgttactggtagtagtgtggcaaatacgttagtggctgctctagcaactcaaaattgggacgtggcgttaccactgctagaacaggaccagttccatgaacagtatcgggctaagttagtgccggcactacaaacggttagagaccatgcccacgctctgggattaacggggacttatttgagtggtgctgggccgacggtgattactctgggtgattacggtcaactcgctacgttgcaggcacaattgagccaagatacaacactcaccggccaattattcctattgccaatggatgcaactggtgtaaaagtacaaaaatcttaaaataagcttgtcagactcgcaaaattttgttatgatactttttgtgagttgttatgcggccatggcggaattggcagacgcgcaagattaaggatcttgtcggggttaacccggtggaagttcgaatcttcttggccgcattttatatacagaatagccgatattgatacgagaaatcgttgatataccggcttttcttttatacatgatagtgaataatacggaatagaacggaacaaaaacgatactattttgacaaaagcgataccagaaacgataccagattttgattattgagccagtattttactcatatcatagacctgtgcagacagttcctgttgggataaatgagcataaatattgagcgtaattttaatatcactgtgacccatttgcatttgtagtgctttgacgttgatattatttgcaacttgaattgatgcgaacgtatggcgcaacccgtgaactgtaattgtgggtaagtctgtttcacctatcaaggcttcgagccaatgattaggtgtcatcactgacatgatttggcctttctggttggtaaagataagatctttagcacgcgggatgactactaacgacttgcgatactttttaagtcggtcgattgttgagctatccagtgagagtgtgcggtaggcatttctagttttgggtgttgatattatctgatggttatcaattgaacgagagatagttttactgattgttaccagcccattcttcaaatcaatatccgaccatgttaacgcaagtgcttcacctttccgcatacctgtggtagcaagtaaataaaacagtgcactacggtcataccgtggttgtgttctgtgtccgtcggtagcatcaacaactgatagaaatgtagccagttgctcagcagtccaaaaattatcagctgctttatcctttgaatagtcaacggaaacttttggaacgtcaactaatttcattgggttattagtaataacacccattttttgagctgtccggaaaactagtgctgcatattgggctagcttattgaattgcttaacgctctcacgccactttaaagcttcttcttggcacttttgccatgtaatcgtattaatcctcatgccaccgaaagaaggcgttatatggtgcttaaagatgccctcaacgcgattcaaagtactttcttttacgcctagcttgtaagtctttagccatacttcgtaaacttcatcgaaagtaggattatccataatagcagccggattgtttttacgatgatcaaattcaactttggcgcgatcaaatgctaacttagcagccttactactactaaaacccccatggtgataggttttagttttggtgttaccgttaatatcagtatactttccaaggtagccacgaacgtcatacacgcgtttgctaccaatcattttatgtgtaattttcattttattttttcctccatattgactatgcgaggggccaaattattggaaaaaatattgcaagcaacaccacctttcagtaaaatagagtatgtaaaaggagtacataactaatgtattctgacgcaagcacatctcaaactttggacggttgggggatgtgcttttttctgcttatagatcgttattagcgaatgcatctcttaaaagaactaatgccaacaaagcaatccatattaagggagaatggaaatgatagtaaaaaacagcaaatataattccaataacgcctacgatcattatcagccacgagactaggcttgaagtgtaatgtttctggtcaagtgaaggattgcttttaatagccggtttatatagagtaaaatgggctattaatgaaaatataaagataactggtaatgtccatagtgaatcttcaaagattgattttggatatgtttcttccaatgccaacactatgaaaaatgggtaaaaatcaatattattcacaagagcatatttccaattgaaattcatcgatctaaccatctccaacaattgttaagttttatattcaaaaatctaaatgcgagcggcaggagttggacctgcatagtactccaagaaagaatgggcttcaagacttggaacattgttctaccgttgaactacgctcgcataatccatatccccaactttggtcggttgaggggtatggttattttgtttagattttaatggtttcagattggctgtcaaaagttcattttacaatttcgtgatataaagaattccactgatcaatgttgtcattcaactctgtactggatggttggttatcgttctcgttgataaggtagccaagataatcacgctgcgttctgagaattttagctgataaattccaaaagtcattaactttatcagcatatcctgaatcaccacttggataattatcaacatccatataattattatcacactctttagcaacgttttttaatacaatcatttccttatgaatggcctgcatgtttttactgggtgattttgatagtcgattaaccttatctgaaatgccgtcaggatcatccatgcgttcgtgcatttcttttacaagagaaacactattggacttagtaaattgttgcaatttcttctttgattctgccttgctacttgcgactgcattttcgaaatttgcctttttaattgattctgaactagctttcgcttcgcttgccgagtctttagattcttggtttgctaattttctatcatctttgacaatagacgatgagtttttactatttgttgcagcattaaattcgggccataagctattggcaaatttaatgtctgctagcaaatgggtcttggcatttgattttggaagtcgtgagacttctttgctgacggatttaatactcgctaaagttgtgccttctaaaagtctagtgtgatcagtatcatcaaatagagaatcaacatctgttttagccttacttaacggactgatttttgaactagtgctatggctatcactgcttcttgcagatttattactatcactgcaagcggtcaaactaactccaattaaaagagtagcccctaacactactacttttttagcattcatttacatatcctccaatgatataataatatttgtatatcaatatcattggttacgacgtctcactgtttgtggcagtggggcgcttttgtttacatgaaagagttagaataaatatttatcccaagaatcttttcagcaatattacgtgcgtctaaaatatacttggaatctaaatcataggcagcagcaaaatgcataatgttaaaatcatctggattaatattacatttatcaatatagttgttaatcattacatataatgcgccatggtttgcttgactttcaattttagaattggatacaaaactagcatctattaacggttcagtacttttatccaataaaacatgtgtaaattcatgatggcaaacaaataatggcgattccactttactattaataaagcaagttcttgtatctggaatcgtataaccgtttatgttatccggaagtgtgtcgacataatgacaggtaatctcatagtgtttcattaaatgatccagatcccacgtacctaaactttgtatatcggttagcgcttcgtctaaagtagtaaatatcatttaatcacatcacttatcaattttattgccttcgttatcatatccaccaaatttgcgtaatcgatcttgtccctccttactattgaggtaagtagaaacgagcgcgcgtaaggcagcacgatcttcatcggttaacgcttggttacgagatgttaattcagccgaattatttacgatgtcttcaacgtcaatgtgtttagggttagagggtttagaagtgtcttttcctagtaacgtgtctgcagttacctctaaagcattggcaattttttttaaagtttctagagaagggtttttacccttgttgtactgataaatgatatttttactaagtccggcttttatagcaacttcttgtaaattcatacctcttttttttgaaattctttttatgttatcaaacactgacatatcaaggctcctccgtgatatgacaaaataaaaataacagtattggtataaaaacattgcaattaataatacctgtgttattattagttcatcaagtaattgagcaaaaaaaatctaagttctaacaacaatactttggcgagtgtgtatgctagaaaggcaggtttttgcttatttaatatgcattaattttacagcacagctgttaaatagtcaagaacttgatgaataaataacaaaggggtgtaaaaatgactgaagaaaaattaattagtggcgctaaagcaattactagcaaaatcaaaatcggtttgtacgaacgtggtatgagtcaagtcgaattgtcagagttaattggcgaaggtccacagcaggttaatcgggccattcacgctgatatgtcacctaagtcagttgaaattcggcagaaaatttaccgtgtattaaatattgaagattaaggaggtgagaacgaatgaatcatgattttgtttatttttataaagatgatagcggtgaaaatattccaatcatgactggtggttattacgaacttgatcgcattatgtggcctgacgaagatactaaaaaagccattcaagatttaatgccttctaagaatgacttatatgttttggttgataaccatgtatttaaattagcttagaccaagcttggatttgataactgatgttgccaattctccaactagttctagtgatgctgtaatcccagcagatttcagcttagccttagtttcgttccaaacagatttgcttcgaatactgttgagatattcattgcctttccaagttaaattaccgggagtgaacatataaggaacggcactagccctagcagctttgttagtaatgagtccagcttggtgtagacagtcaacagtataggctaattcttcaatagttacattctttgactcagcaaaagaacgcatttcatcgttacttggaccatagggattggttgaattagcacattcaagcaacatatcgcggacaaagtcatagtttaattccacattaatcacctcgattgttttgaattaaacaaattataccttattagaaaggaagtgaattaaatgccaacaacattagctggacgggaacttatcaagaagtatattgatgatcgtgaaattagcattacaagcttggccgctacatttggtgtaggaaagatgtacatgacacaagtattggccggaaccaagaagtctgcagcggctaacgagctagttttgaagattattgagacttttaaaattcgaccacatgaaggagatgaataagagatgacggaaaaattagttctaagaaaacaacatcttaatggcaataatggaaccaagccaatattcgttgatgtctcaatttttgattccatccgtgaaattaaagaagaaaccggaatcccaatgagaagaattgttgaacagtttctatgttatgcaatgaagaatgttcagattgttgatgaggaggaaggtgatcagtaatggatggtgtcacattgaatttaccaagtgagtccttagcaccaatcaagcaagaacttactcgtctaattacggatgtgttcaagcaaatagctcaacgcgaagccttaccttattggatgaagaaacaggaggctcagatttacatgaatgttagtgacaagactttagataagttcattgtcgacgggctaaaagtttctattattgacggcactcagcgaatttctaaaaaatctgcggataagtattacgaagatcacgaattataaatagtctatgcgaggggccatttatcggaggtaattaataatgattgaagtagcactgattacatgggcgctaacagcattatggtttaagcggcatgaaattattagttggtttggaatttaaaggaggaatatttatgtataacgaatcagaaattgaaacggcactgacttatcgtaactactatattgccgcaaaagcatatcaggaagcagaacaagagctgttaaccactattaagtttacaaccgttcgtgaagtttctacggcaggcaataagaaatatcgaccagcctttcttaattctttgagcagtcacggaatttattatcgaacgccggctaatagcaaggatggtaagtggtactttacactaccagacgccaaggaggttactgatgaagacctattctcataagccgtttgaagaatggcgagcaaaacaaaatacctgctaccgggtgcaaccagtaacaggtacgaaattgaaaaataaccaaataattttacaggtttatggtacaccacgggcgaacctatggcaacaactgaaagggacatttacacatgaataattacaaaacacaagcaaaacattggtatcgaaagctaatgaagacgccagttgggtatgtatgtttagctacttatcggttcaagcaatggcaactttacaagcacttggcacggcaaacggcaatggatcatttgcgaggtgaagaccatgcggacattcaaccagaaaacaattagtccaggaatggcttactgcgagtgtcttggatatcggtacttctatgaagactcaactcagtttctagcatggttaatgggtgtgctaagcccggaagcggtattagataaaattggtgttcaagaaaaggtgcgtgaataaagtgattccaggatatgatgaatggctagagcctccggaagatgatgaccggcctactaaggaagaattaattgaattaggtgtgattggagacgatgaagaatgaacttatatgaaatggcgaccaactatcgcgacttaaccaaccgtgatgacctgaacccagacaccattgctgatacgctcgatgcattgactgactcgatgaacgtgaaggtcgataacattgcaagctggatagatgagaaccaagcgaatattgatttcttggataaaaaaatgaaattgttccgtgaagaaaagcaacggttaaagaacttgaacggccggctaaaccattacgtcgcggacacacttgatcaggctggaattaagaaattaaccacggaccaacacttggtttcagtccgaaactaccgtgcatcaaccgtaattagtagtccaggcttactgacagctgactacgttaaagaagttcatgaataccagccagacaaaacggcaatctacaaagcgttatcagctggcaagaacgtacccggcgctcatctggaaccgaatcggaaggcagttattaagtaatgcaatacacagtgcggaaaggggtggttagggatgtttcaactacgtgactatcagcaggaagcagtggatgcagtttatgattcaacaatccacgggcataaagccattgtggttcagtcccctccctcgaaccggtaaaacagttttaatggccgatattgcacgcagggcaacggctaaaggcaaccgggtattatttatcgttcaccgccgagaaatcctggaacaagccgagagtacgtttaaacaagacgacgttaacatgtcactttgcaagatgggcatggttcagaccattacccggcatattgatgagttaaccaaaccagccatcatcatgattgatgaagctcatcatgcactgtcgaagtcctaccaaagaataattcaagcgttccctgacgcgcttaaattgctgttcactgcgacaccgtggcggatggacggcaaaggactagacgtgattgctgacgatattgtactaggtaagcctatcagccagctaattgaccaggggttcttggcaccagtcgactattacgcgccgtcagaaattgacgtgacccaacttagaaccaaacgtaatggtgaatttgatgaaaaaagtattgatcaagccgtgaagcctaagatttatggaaatgcagtaaagcattacttgaaactggcaccaggtaagcaagctattgcttatgcgtacaacgtggcgagtgccgaacgactggcggatgcattcaaccaagctgggataactgctcgggcagtatcaggtaagacagatagaactactcgtgagcagattgtggcaagttatcgtgctggcaagattcaagtggtcaccaatgcggagttattcacggaagggttagacctaccaaatgttgattgtgtgatcatgctacggccaacacagtcactatcactttacttgcagtttgccatgcgatcaatgaacccaagggcaggcaagcgggccatcatcatcgaccacgtcaataacgtggaaagatttgggttgccgaccatcgaccgaaactggattctaagcggacgtgataagcattcgaaaagtagtaacggtagcccgattaaatcagtgtccgtttgtccggagtgcttcgcgacgttttatcgcaaaggtgagacctgtccgttttgtggggccgagctgggtgaagaaaaaattattgagaccgacgaatctatcaagctcaaaaagattgaagctaacaagcggttggcattagcgaaagaaattgcagagaacaatgctgctaaagcagtagccgataagtcgccgggtgagttaaccacgtacgcggagattaaggcatacgcaaaactgcataattttaaaccgggttgggtttattttcaagcaaagacaaggggactgattagaaagtgaaaacaagaatccgagagttacgccggttctatgggtacaatcagactgaattagcacggtcaattggtaagacaatgcaagcagttagcaaatatgaattggatcaagtcgaaccaaacattgccacactaattaagatggcaaacctatttaatgtcacaatcgattatttagtaaaaaggagtgattacatcaatgtcaattttaccaaagaatgaaccccataagcctgctggaacccctcgtaacttctttatttggggccaaacaatgagcggtaagagttacctagctgaacatttcccaaatgtattagttttgaatactgatggaaatagcgccatgggaacacgtccaagcattcaattacgaaatgtacgcaaccctgatggcagtttaaagagtagtgtcattgaccagcttcaagaagtaattttggagttaggaactacccaaaacacgtacgagactgtgacactagatgttatcgatgatgtttgccagctgattgaacaggcaatttgcctaaaggcaggggttgaatcgttagcagacatggggtatggccgaggatatgcattgttcaatactgtgcttcaaagtctggtaatggatctcaaggcattaccaatcaacgtcgtttacattagtcgtgagaatgactttactgacgatgatggtaatacgaagactgttccgtcactcaaaactaagtattacaacgtggtcaacgggaattgtgacttggttatccatactcaacacgttggcaagaactatttacgaaacgtgacagaaattcgtcgccggtataaagccagtgaaattaatgattcaaagattctcagtattctgaaagctattccgaatgcattagcaccggaagtacaaacaacgaaagcaggtaaataaatatgagtttattagatattgcagcaaacactttagataactttgatccaaagaatgattcagtgaacagtggaaacacaggattaccagatggtgattacttaacggctgtggaaagcattgaacatcgatcattcgattcaggttgggattgcttacagatcgtgtttacggttcttgatggcgaccacgctggcgaaaaagagtacgaccgcattagttttgccactaagagcaaagctggtaaggcgattccagatttcattcttagccggagtattaagttcgttatcaagttaggttcactgttaggcgttgagatgaagccagaatactttgccagtgagaatgaaactgacacacacgaaatgttagctaatgtacttgcaccagaaaaaggtaagtcggtgattttacatgtcaagcatcgtccaaacaagaaggatcccgacaacccctacgttgaatatgacctagacgcaactgaacagcctgaaactgcagacatcacagatgcagacttacctggcgacttaggtggtgcgccaatgccaacagatgcagacgcaccagcagaaccaacagatgaagcaccgttctaaataaatactgcagtgccagtaaaccatcgttcgggtgtgatgcccgttaatttacagaaggaggccggtcatgcgtaatttagttaattatgcagttagatacgccaaagcggggttcagcgtcctgccaatgattggcaagaaacccatgattaagttcgctgaccagcccgccttgaccattgatcagattcaaagctactggcggtcacacccatacgcccaattagcactacggacaactaattttttcgtgattgatatcgatgaacatcccggcggtgcggatggttttaaatcgttcaaagactatgagcacccagagtatttccgggaaacattatcgcagaagacagcgggcggcggccggcaactattttatctaaagcgtgaagatagcactgtgcagcagaatatcggatggctaccgggaattgatattaaggctcacgttaacaattatgtgatggtcgcacccagtgagcggaatggtaaggcgtatcaatgggagaatcacaatccaatcgtgacggccccacgcgagctggtccaagcaattaatgcgaaccgtgacgatactgtcgacgtgttcacagacctgaacattgattacgctgagaagtcaggaacagccactttgtttgaaaccattgtcgatggtttgggtgccaccggcggccgtaataatgcattggcgagttttgccggcggattgttattccggggtgttgatccgcgagcagttatccagctaggcttactggcaaatgcaaacacggacgattcactgactcagcgagaagccaagacaacgattgagtccatgattaagaaagaaattagacgaagggaggctaaccagtgagcgcagaggaagaagcggacaagctccgcaagttagaggaacagcagaaagttgtaccgcttaaaaatcgaattaattttatggaaacggctaagggcggtattaaagcaaattcacttgaaaatgtttgtctgatattagaacacgatccactgcttaaaggcaagttcgcgtataacgaatttagttacgaaactgagttcatggaagattcagccgagctaatgttggaacatggaccactgcaagatgagttcacaccagcagtacaacggtacatcgaacgtaagtataaagtcatgtttaatacaaaattgatagaagccgcggtcactgaggtgtcacgtcgaaacgtgtttaatccagtgattgattattttaaacaatgttataagaaatgggacggtaaaaagcgggtcgccgacttcatgccaatgtatttaggagtagagaagtctgcaataactacgttggaaactgaattattttttgttggggcggttactaaagctttcaagccggaaactaagttcgattttgtcctagacctggttggtggtcaaggggcgggtaaaacgacactgctaataaagatggcaagcggttggtacactgatcaattcactgattttgaaaacaaagacaacattggcaatatgatgcgagcattgatcgtgaatgatgatgaaatgaccgccacgcgtaacagcacttttgaagtgttaaagaaattcattagttcattgaaagttgaataccggccaccatatggtaagcattcagttcggcgttacaagaactttgttttggctcgcactacaaatgagaccacttatctaaaagataaaactggtgaacgtcgatttatgccgatgatggttaataaagaacgtgccgttaaatcaccaattactgatttaccacaagtaactattgaccagttgtggggcgaatttgttagttattaccgtgagggattcgacttcggtttaacgcaggagcaggagcaagcgatgactaagcatcgtgagcaattcatgtacattgacgctgaagaagatgctatcgaacaatcactagctcaaatcaagggcgattttgttacgagttccgagattgcattcaagatgggagttccggatatcgttaagaatcgaaaattagccaacaaaattaagtacgtcatggacaataaaaaggagtggcacgcgacacaacgccgagtcaaaggaattcctaaacgtggctatgcccgtacgtagcaagtgtagttacgttgtcacaggcttaatgactacggctggggcctagagccccaaggcatacattaacatgtatacactactaataaatattatatatatatatatatttttatatagggtatagggaataggggtatacggtaaaggtatgaaaaagttgaaaatgggtgactacatcgctacatcattgttaatcccttgggacacaagggattagacgtaatcggacggcaaaagtgtagtgtctaaatagtgattacggaggaatttatgcgagaacaagaaatacaaaatcaaatccgcgtggcggtatctaaaaataaatgtacaattttccgggcgaatgtcggcaaagttaaaaccgaagatggtcgctggttcgatgcaggattaccgcaaggctttccggatttatttgggtttcgtcattcggatggcaagatattctttattgaatgtaaaaatgaaactggacggccacgggctgatcagattaaatttcataattttttgacaaaacaacacatgattcacggcattgcacgtagtcaggaagatgcattgaagattattaatgagggactggttggatatggattctaattattacggaggacgagaatgcctaaacacactaagaagcgttcaacgattaaacggaagcaccggcgcatgatgaagcatgccgaagcaaataaaaaatcaaccaaataggacggtaagcaattatgaaattaaagattgaaaacaatgatttgaccgtaacagttgaagcaactcgtgaattgagttttgaggaaatttttaagtcacatcagttggtgactggtcgtaatgatgaattaaatactggccgtgaggaaaaacacgcattcgttccggaagactcaggcgaaatgaatgaagactctaatactgatcctaagtttgacttcaagaaaccgacatgtatgcctaaagatggcgagatggtaaaggctgaatttatgtgtccacagtgtggttacgataaagtaacgcatgttaagtttggctataaccgttggaattgccctggctgtggaatcagattgtttcttgcgtatgcaacaggtactcgtggagtaaaagacgcaaatggattttactacaaagctaatcgagaatttattagtcgtgcacctgaaaacagtgatgatgatttttccaagatgtttacccggtcagatgatccagagaagccggatgcttatgacacaatcccagacatcaaaaagtatcttgataagcacggcattgattattcccatgcaaagtttaaaggtgactatgttgctttaattccagaggattaatcatgataatcatcaaggaaccaactaacgaggaacgcaagcggtcgtttgaagtgttcggggaggattgaaaatgagtattagaaataaaattggaattggcatgatagccttatttattttagtcacgatcgtcggaagctttttagaaggattctggcatggagttatttttatcagtgttgtggcatgggttgtgatagcgctggaactatcgagttctaggagataatggagatggcgacgatgattaagtttagagcgtgggaaagcactgaaaatatgtgccgttttgaaagtcttgatgataaagcaaatgagaggtttaaaacagctaatgaagtttatcgccacaaagctactggattactaactaatttgtaccaaaagctaaaagtaagaaataccaaaaggggctatggagatttgaatttcgacttggcacaatttaaagattggtcagctaatgaacctagatttttaaggctttttaggatatgggtatttgatgattattcaaaagattttaagccgagtgtagatagaataaatccgtatttaggatattcattcaaaaatatgcaatggctgacttggaaagaaaattatatcaaaggaattaatgaaggttcgagtaagaaaaagaaacctattattatgactaaagagggaatagtaattggaaggttcaaaagtatacaggatgctcaatattttttaaatttatcatcaaacggtgatatttcaagggcactattaaacagtaataggactgttaacgagtatggttttaaatatgataacccagagctattggaggaagaaaaatgaagaaagcttatcgtaaaacagccactattagggcagaacaattcgatggtagtgatgagatggttgataagtatgaattaattgacgcaggaacaatgcttggaactcaccacagccctgaattatatctaacagggtcaggtaaattaaacgttggtgactggattgcaaccggcgttaacggtgagcactggtcgattgcagacgacgtattcaagaagacatatgctgaactaccagtgattcctaaaaacgttgctaagcacattgtaaccgaacacgggcttagtgacttaattcctagtggcggaatttacagagctatgatccaaacagttgtttatggatatcagaaaggcgatattggcgactggattgtcaatcatagtgatgtttttgcccgtgcgtggctagacgggtatcaagtggaggaagaaaaatgactgacaccgaatacgccaaagcaatcaaaagcttacaatagtgcatgtattttgacaataataaataatgccaccatgataattgcaggtaaaaattatgcgatagtagaatgaaggcgaggcacagactatggaacgtattgatcatgaaaagcttaacaacctggtatgtgaagttgaagaccgccatgaaaatggcattcttggcgcaaacgaaaaataaatggcacctatttggaggataaccaaggctacaatgaagagtggttatttagtagtttcgttgcggcaatacaatttaattgaagcatacgcagccaagagctcacatacaacagaggagaagaaccaaaccttaaagcaactgcataagaaatacagttggctaaatcggcgagtaacagaatatcgccatggcaatttaattattcagagttgaggtggaaagtggtgggtgattttgaaactaacaagaaattcttaaggcgttaccggccttactttagacaaatcaagcggcttgaaactaagctgtttgtcattgatgaccgtattgagtcgacacattcacctagtatgactggacaaccaggtggtggtaagcggcgcgagttggctgacgacttaattcagcgagaagaaattgaggcacgtattaatcggctgatcaagaaaagccgtccaatcaaatctgaaattacggattgtcttgatgaattaactaattcgttagaagcttctattttagaacagtattttattgaagatattcagctggacacgattgcgttacagatgagttattcgttccgtcaggtcaaacgattgtacggtgatggggttaagcatgctaagatacctagaaattgtgacaccctatgaaccatgtcccctgaatgtcccctagatgtcactaaaatgtcccctgaatgtcacttacatgccgagtaaatgggtgtatatttgtattatcgaatagttaataaatacgaagcgtcataccaaacggtgtggcgttttttaataccatcattcctgggagaaggatagcttctggggtgtaaaaatactcgaacaccaattggttccgactagttggcgagcgcaggctacagttagtggtttatggtagcactatccaagtgtgctgtggcggaataggtagacgcatagtcagacgcgagtaacgggtatcgggtgacactgatatgaccacacgtcatataaggtgcaaatccttatcggcatattaattaaatttattggaggtaatacgaatggaacaatctgagttcaacgtaacacagacaatcaatgagacttgctatagcttaattaagcagggctattcattgcacgatatctatagtggcttgggcaatgttatgaatgggatcgagcctaagcatcttaccaagcaagaactggtcattgatctgaatgttgacacatccaaggtagcttgtaagttacgccatgtcatggacaactgaacaatgccgagcattctatggttctgttgagtgggagcatttgcgtgctgctatccttaaacgtgatcactatgaatgtgtgtggtgtaagcgcgatggtaaggtcacacggtatggcgacgttgatagccatggtcgtccggttgtactggaagttgaccacatcaaagagttggctgactatccggaattgcgaaccgagccgactaacctgcggacactgtgcaaggattgccacaacaaacgacatcatcgcatgaactatcgaagcaagcatgagcgtaaagagaatcggtggagcaaggacgagaggtgggattaatggtggaacataatataacttggtcaatacacaatggacgaaaggtacctaagatctatgttgatggtgagcaggctcaggtagtgtcgtgtagttatcagtttgtaacggctacagatattgatgagtcaggagttagcatgatgactgcaaccatcttcttattatcggagtgcgactataagcccattcagcatgtgatctttatcaatcaacagactggtaaggtgttctatcaatagacaaggagtgatgaataatgcgatcaagaaccgataacactaagcaagtcgtggtctacgtagtcatgcgtgaccaacaagcaaatgtattatttgcacatcgtgtttattttagtgaacgacgagcgaagaattactgtaaacggatgaataatgcaaaagaatttactggctattactacattaataaagcaatcttttttgactggaaagcatttatttctaaatttacagaggcccccggggtcaaaaaaattggcgaaaaatagaaaactgggaaccggtgggtaggactcgactccggaaaaatattgtttttttattcaatttgaaaggggggtgggggtttggaccaccgtaagataagaagggaattgatgcagcgaatcgataaaaaatcagctgttgagaaagagaaggttgaccgatatatcagtcttttggacgctttttatcagcttgatgaaagcatacaacagcatggcgtgatggtcaaaatcgagaatggcaaacagatatactggaaagcaaatccggctgtttccgaaaaaaatcgaattaattccgcgctaataacgcttgaaaaggactttaagaccgttaaaaccacccctaaagcgtctaaaacagctactacgagcgacgaaaagggtggcttggtatgattcaacagaagtatgttaaaagttacctacaggcctataaagacggttctatcaggttgaataagcggcgaataaaactcgtggaattaatagaaaagaccgttctaactaacgaaaattattattttgatgaagaaaaaatcgaggactgtttaacgttcgctgataagtggtttttcccatttacaccctgggaaaaattcttaaccgcgttcgtttttttatatgatcacaccactgagcgacgagcaattcggaagttcatggtagtcgttggccgtggggctggtaagaacggctgggtatcggtgatttcatcttttcttttatcacgactgcatggggtccgcaattataatggttccattatcgccaatagtgaagaacaggccaaaacatcggttgatgagattcacgatgcggtcgacttgcatagtgagttgaaaggcgaattttatgcgaccaattcgcaagttcattcgaagtctaccaactcgacgctacgataccggacttctaacgggaatactaaagatggcttgcgtgatggttttgttattttcgatgaaatccacgcctatcccaataaccaaaatgtcaaagttcatatttctggacttgggaaagttcgagactcacgagttttcgagattgggtccaagggctatgtgcgtgatggctacctagataaagaattagcaaaagctgatgcgattttagacggtaaggcccccattgaatcgatgtttccatttgtttgcgagttggacaacttgaaagagatggacgacccagccaactgggagcttgctaacccatcattttctaagccgatgaatggttacgccaaagacgtttaccaggagactatggacgactataacgacctggaactagacccgtccggttatgatgagttcgttattaagcgcatgaactaccaggttgaagacctagaaaagtcggttgccccttatgagcaaatcaaagcgactaaccgtccgattctactggacgacttgcaaggcatggaagcgattggatcggtggattttgcatctattcgcgactttaccgcagacgggttgaccatcaaacgagaaggcaagcagtactttatcagccatcaatttgcccgccgtcaatttgtcgataagttctatgcgtattcagctaaaccacaagaccgcccccagtctgctcctcctattgctgaatgggaagaacgggggttgttgtccgtggttgacacaccaaccattgacccacaagcagtcgtggattggttcttagagcagcggaaacgtttcatcattaagaaagttgtcatggataatttccgggcggatttacttcgtaagttctttgaagatgcaggctttgaagtcgttgtcattcggaatccaactgccattgatggtttgctggcccccaggattgagacagggtttgccaatcatcaatatatctggggtgacaacccgttattgcgatggaacacacagaacgtgctggtttcgaccgatagccacggtaacaaacgatacggcaagaaagaagaaattcggcgaaaaactgatggcttcaaagcgtttgaatatggccaatatctggttgaccagttacccgactactcggtaaatgaatcgctagatatgttggcagacattgatttctaacggaagggaggtgaatatatgagtgtaattaatagcttctttgacctgtttacgcggcgaaaagactccagctttatttatgatcttgatttgttccaggatattaagaaccgagcctacttaaaacgcatggcgattgacacagtaatcaattacgtaggccgggcagttagccagtcggagtttcgtgtgatgaacaaggggttacctgttaaggatgcgatgtattacaagctcaatgtccgaccaaatactgacgaatcggctagtgatttttggcagcattttatctaccaattgatttattacaacgaggtgctagtgattcaagacgacgatggcgatttattaattgcggatgattttagtcgtcacgagtttgctgtgtatgaagacgctttcgacaatgtcacggtcaaagaatacacgtttaagcgttccttcccgatgtctgatgttatttacttaagatactccaatgaccagctagaacactatctgactggtttgtggggagactatggcgagttgtttgggcggatgtatgagctagaattgcgtaataatcagattcgcgcgactgttaaggctgatatgacggctggtgttaatgacggtaaagcgaacaaactgcagatgtttattgacaagattttccaatctttcagcaagaactccgttgcgctggtaccaatcactaatggttttgagtataacgaagtgtcaaacggtgtgggtaagaaccagacatttgatgaaagcaacagcgtgctaatggcattcatcgatcacgttgcacggctggtgggagtgccaccggcgctgatacacggtgaaactgccgaaagtagcgataaccaagaattattcaacaagcagtgtttgagtgcactattaaataagattcagtcggagcttaatgctaagtcattcagccagcgagattacttaaagaatggcaaacaagttgaagtaattggtattaatcgaccaacactaattgaactagcagaacaaatcgacaagcttggctcgtcaggtatggttactcaaaacgaggttcggtcagcagttgggttgccaccacgtgaagacggtgaccagatagtgatgaccaagaattatacaatgaaaggtggtgagaataatgaagaagattaacgttaagggtccgattattagtaacgatgacaagtggatttatgacatgttggaaatggacagtactgctcctaaggatgtcattgatgcattaccagatgatggctcaactgttgaagttgatattaattctggtggtggtttagtaactgctggaagtgaaatctatacagcactgatgaattactccggtaaggtcacggtcaatattatgggcatggctgcaagtgccgcgtccgtaatcgcaatggccggtaatccaacacgaattagtccggttggtcaaattatgatccataactctgcggctggagtttatggtgattatcgtgatcaggacaaattgtcggacatgttaaaacaactcaatgaagcgatggccaatgcttatcaattgaaaacgaagttaccgatggacgacttgttggctaagatggactctgaaacctacttgaatgccgatcaagcaaaggagcttggattcgtagacgaagttatgtttactgatgataagattcaattggtagcggatgctggttctgggctattgccgcaaacggcgattgataagattgccgagttagtcaagccagctcctgatttatctgatactgatattgaccgtatttcaaacgcggtcgtacaaaaattaaatgttcaacccacaaagcaagcggaaaacaaatttgttgatccgtttgctttttaatttagaaagaaggaaaagtaatgattaaatttgatacaaatgttttcaaaaactttactgacgcacgtgaaaagtacgcacaattggtgaagaacgctgccaagcccgaagagcaacaacagggttttactgatatgatggacgctttgggtgaagatacactttcagaaattaagaaccaagttcacgctcaaaccgaagattacttggacgcccgccgacacgaccccaagatgtcgaacgaagaagtgaagttcttcaatgaaattaagacagacactggatttaaagaacctaagttattgcctgagacggttgttactgaagtgttcgatgacatggttcaagcccacccgttacttcaagctatcggtttgcaaaaccaaggtattagcttgaagattatccaatcagatgcttccggagtaattagctggggtaatattttcggcgaaatcactagtcaattagatgctaagttcaaggagactaaagctgaccaatccaaggcaaccgcgttcttggtattaccaaaggacttaagcgacttcggcccatcatggattaagcaatacgtaatcacccaaattactgaagcctttgcggtcggcgctgaaactgcattcttgactggtgatgggaatcaaaaaccaattggcttaaaccgttctgtcaaggaaggggtggccgtgtctggtggtgtttatccggaaaaggaatccgctgggacgttgacgtttgcagataccaagactgctgctaaagaattagctggtatgatcaagaatctttcaactaaggaaaatggtaagccagttgtggctaagggcaagactgtcatggtcatgggccctggggaatcattagatgtagaagcgcaattcatggttcaaaatttggcgggccaatttgtcactgccttgccatttggattgacgattatcgaatctgaatttgcgcctgaaaacaaggtgattgcattcgttcaaggtcgctatgatgcattccaagccggcccattgaagattcaaccatacgaccaaacgttggcacttgaagacatggatttatatacggcaaagcaattcttctatggcaaggccaaggatgataaagcagctgcggtttacgacttgaagcttgctactcctggtactacgaccactgaaccaacgaccggcggtgacacgggaaaatagcgaccccggacaccggggtaactaagcctaccgcgaacagtaccgtagctgaaatcactgcttggttagatgctaacggaatcgaccacactggagctacgttgaaggccgatttactagcattagtggggtgattaagtgaatccattgttagatcaattcaaactgcgtatgaagatttatcacaaagctgaggacgcaaatttatcgcgaattctgaatgcaagtcagaagcgtatcaccgatattactggtatcgccagtaacgccggtgatgatgtgtatgacgagctagttttagaacgagcacgatacgcttacaatgaccaagtcgagtttttcgacgctaattttttggacgacttattgtctgcgtccttgaccagctatgaaccgggggatgatgaagatgaaccgaccggagtttgagtacaaagcaccaccagtaagaacgaatcagcttaatacgccggttcgtttttttcgtaccgtcaaaaatttggggccagagccgggtcgtggtcaaactgaacaagcttttgagtgtttgggtttagcttatgatccatccaccaaagaccgtgaagtgcttaacgttaatgaagcaaagtatggcgtgactatcaagattcgcgatacttttggcgaatttgacccatcaacacaagataccgtggtcattgacgaccgccgctatctagatgccactggtcaaccaattgtttggaacgttatccaggtagcaccagatttagaaaataaccagtttgtaaaaattgtgctgggggtgactaaatgacggaagtaacggttaagtttacaggtgttgatgaagtaattaataagttggccgaaaagtttagcccagcaaaactaaaccgtattgaaaatgatgcgttaagagtagccggcagacgagtagcggttgaactcaagaatgcggtcgccagctatcgtgacacaggtcaaacagttcttcaagtatcagtcggtaaccctcatagtcggggcggtgtacggacgattaagattggttggcatgcgggatctcgctggcgattagtccatctgaatgagctcggttatacacggttcggcaaaacctatcatccacgaggcatgggtaaagctcaaggtgcatttgatagtagccgtggccctgccaaggcacttgaagaagctgaattgaggaaactactatgaccgaaaccaaggatatgcttgcaactatttataccgcgttgttggcaaatgcaacaattgcaaaactgacattggctggtgatggcagtcatcgaattagttattttgaaagcccagaaacagctgaccacgacaatctatttgttgtgattacacctgtcgggccaccggtaccagcggctgttggcagtgatgattatttgaatgtgcaattcacgtttcaagtcaatgttgaatctatcagtcgaccggcgcgtaatgctgtggcacgtgaaattcaaaacgaaatgcttgctttgggcttttcaagattagctggtgctcagaacgaattagatgaattcatgactgaaactaaccgctttgttgatgttcgcagataccgtggtaacactaaattgtatgacacaaattattaaggagagatgtaattatgtttgtaggatataaacgattaaagattcaaccatttgccgaagacggcacgaaaaaaggtgacctgattattgttgaaggtcaggcacacaaaggggctacgaccactgctgaaatcagtggattagctaaagaaccagtgaaagtaccagggtctaatatcgattactacttgtcacggcaaggcttgggtgacgccaaggtagcacttggcattttagatttaccggaagctagcgctgacctattggctggtttccgcgtcgatgatgacaagatcagctatggtggtgaagacactttaccgccatattgctcaattgaaatggaatccaaagaagacactggtgaaattgcgttagttggtttcttcaagggaacatttacgcgggataagattagcttgagcacgctggattcatctaaatcgtttacgccagaagctgatgcctggacttttacgccaattagttcgattgctactgcaactaatggcgaagtgatgcagaagtttgttggggatacaacaacggatgcaacgactgttacgaagtttgaaaagcaattgtttgatccagcaggtaacgatacaaccccaagtaatggataattctgaaaaacatattgaataactaaccattagtcgccgataaatcaacaataccaattggggcggctttttgtgtatggagggaaaagactatgagtacaccactaaagatggaattacttattgatggtaaaaagcagaccttcacggaatcgttcattccggcaggccgtatcttggacgcattggacttaatcgaaacggataactcagatcgtaaattgcgtgatgtttttgaagaacgagtagcatttttagccaaagtatttactaacccgttagtgacaacagaagcaatttggaatggtttcaatgcgattgattttgatgatcgcacgttcgcaattatttgcaaagtggctggtgtaaacccaaaaaagctacagatggcgacgacaccggaataaccatcacagaagctcgtaaaagtgtgttatcagcagtcggcgcaattgttgaaaaccgcaccggctatacgcttgaaagcgtactaaacagcgttgattttcaattgttgtcgcaaataatcgaagcaacgaccgaacagactcagcagactgaaagtgggacccgagttaaactgggtgctgtgggtgtaaatcctggtaatcagcctgtcatgagtctttttgactttgctagaaaatcttaatgaagggagaaataataaatggcagatgaagtattaggccgcatggtcatcgagttagggctggatcacgctgcgtttggtaaagggttaaccggtgctaaacgtgaagttaagtatgcaatggctgagatgaaatcatcaatggctgtactcggtcaatcgggccgccagtttgacgtcctatcagctaagtctaaaggcttgtcacaagtaatgatgagtcagcagcgggttgttgaaaaactgggtaaagcgtacaaggactcgctggttgatggtaaaccaaccgcgcaaacagctaagctagcaactcaattgcagaatgccaatgctaaattagcctcattacaaactcagtataagaataatgcagcggcaatggctaaagcacgcgttgagcaaactggttttaccggtggcttaaataaagttagcaaggccgctgtagcgactggtacatcgatgaagaacatcggctcaacgatgaccagcaaagttagcgccccaattgcggctggtttagccattgcaactaaatccgctatcacttttgattcgcaaatcaagtccatggggcctctgctgactaatgggggcgcggttaccgctaagtaccggtcacagttggatcagttgggtgatgcatctaaaaagatgtcgatgaagtacggtgtctcgactactgaaatcaacaacggcatggcggaacttattcggcgtggttacacgactaaccaagttctaggctcaatgccgtctatcttagatgcaaccatggcttccggtgaagatatgggtacggtcatgaatgccacagcgtcaatcgttgaacagttcgggttaaagactaactcaacggctgggacgatgaagaacactcagcgggttaccgattcgctgacatacgcggccaatgcaactgcggctggcttcggtgatatgtctgatgcgatgagctacgtcgggccggttgcatctagtttgggtctcagcgttgaacaaactgcggcggctgttggtgagcttagtaaccaaggaatcgaaggccaaaaagctgggactaatttacgtggtatgctgactagtttgattaagccaaccaagcaaaacaccgaaggattcaagagtatgggcatcagttcgaagcaactagctcatgactcacatgacctgccacaactaattgatgatatcacacatggcactaagggctggtcaaacgctgaacgtggtaaggctttagcccaagccttcggacgtgaaaaccaagctgctgctaacgcattagttaaggccggttctaagaatctgcgtgacttgactaaagatactgagaacgctggtggtgcgactaagaaagttgccgagcaaatgagcaatacttcggcaaataatgtcaagaaactgattgcgtcattacaagtgctaggaattgaaatcggtgagaagttaattccaaaactaacaccgttagttaagaaagccacagatatggttcaaggtttttcaaagatggatgatgccactcagaataccattattaagtttgccctattagctgctgctggtggcccagtattgagtatgctgggtaatatcgtcggtggatttggaacatttgggggcggtattgttaaagttattagcgctaccgcacaatggcacgcgaagaatcaagcagctaaagaatcactcgcgatgttaaaaggtgcgactgataccactagtggcggtttcaaagcgttcaagggtagtgttgatactgtaaatggctcagcatcaacggctaagtcaacatttggcttgcttaaaggtgcctttaccactgctgaggctggagctggtgtattgggaacctcattaagtgtgacgggtgcggcggtgaccggtgttggtttggcagctgtagctggtgtggcttactggcaactctatggtaaggaagcggcagctagtgccgcacgaacacggcagtggggttcagatgtcggtgaacaggctgattccgcactgactaagttcaagggatttagtactaacgctagtgcgtcattgacggattttgagacagcaagtcatacaagcactaagagcgttgccaaggattttggcgatatgtacactgagatggagaaggattccaaagacactatccagcagatgcagaaggatatgaagggcctacccgactctgttcaagatgacttaaaaaaagatatcgctgatcgcaagaagcataatgctacagtattggccgatgctaaggaaaattacaataacgcggaagcaatactcaagaaccacaacggtaagatgtctggcttgagtgatacagaacgaactgcattactcaacagccaacgtaaaatgaatagcgatgaaattagcctactaaaaattggtggaagtgctaagaagaacgttctagctgcattgaatggggatattggtaacatgacccgtaagcaacgtgatacgaccattaatcaattgacgtcttcaatgcagaaagaaaacaagctttacaatgatcagagccagcagatcaagtccatgtacgataaaggtgaaatttctgcttctcaatatggtaaagcaatgaaagatttacaagcgactcatcgttcaacaacggataatatggctgcagcaatttataagttggacaaggcgaatgggacttctaaagctcaaattacgcaggatttactaaatgttggctacacttacaagcaagcagcggcgattgtaaaacggcaaaatgatgacatgagtaagagtacatccttggtggttgctgaaactggcaatatgagcaagaagtctaaggcggcagccgatacctggaatagcttagtatttgattccaagactggaaaagttaagaccaatgcgcaggcagaagtcaataaagctgctaaatctaaggacaaatggaaccagatgaagctactggttaaacaaggaaagatgagttccaatgccgcggccatggttggggttgcggctgttcagaccaaacgctgggatggtttaacgcttaaagagaaacaggctatgattaagtctaaaggtggcgatgatctagccgggttaatcgaaaagggcaaacaatggggcaagtttaccccagccgaaaagaaggccatcattacttccaaaggcgggccagaactcttaggcgtcatgactaaggctcaaacttggaataagttaacgatggctgagaagcgggcagttttaaaggacaacgcgtcgccagccatgaaacaagcttcggttagtgtcaaggactggaataacttaacgccacaaatgaagacggtcatggctaaagctaagggtgccgaagatgttgctaaaggcgttaaaaaccttaaggattggaatagcttaccagaacgtgaaaaacggttaattgcaaacgacaagggcgctacgggaattattaagaaggtaactggtaattataaggcttatcagaatttaccaaaaaacgctactaagaatttatttgctaaggacaatgctagcaagaatgctggtaaagctaaaatttcagttgacaaatatggccgggttaaggtaactggtaaggtacttaaggctactgataaggcgtctggtcctgccaagagcggtaaaaagggactagataaatttaattcaaccaaaatgcagactaaaactgcaaaaggtaaggattcggcctcagattcaatgaatggtgcacgtaaatcggcaatgaaatataacggcgttaatatggcactcaaaactgctcgtggacatgacgctgcatctagtccaattaacggtgctcaccggtcgcttgatcgatataacggggtaggtatgcgcggaaaaaccgctcgcggatatgattcagcaagcggtgctatgggacgcgctaaaggttcgttaggtcgctacaacggaaccggtatgcgagacaagactgctcgtggtcacgatggcgcttctggtccaatcagtagcgcaatccgtactctaagccactggaatgcaatggggaacgtgactcacttcattacaactgtttttcgtaaaattactcggcacgccacaggtacaactggtaccgatggtaatccaatcattgttaatgacgaagaaagctcagtattccgtgaagctgtcaagtatcccgggcatccagcgtttattccacacggacgtaatgtctatctgaatgcaccaaaaggaacgcaagttattccagcgggattaacggccaaaatgtttggtgtctcacagtatgctgctggtactattccggctaattcatcaattatccaagcttcgaaagccatcaatgactcaattggcggagataataccacaatcaactataacttgggtggtagcgacagtacacaagcaatcgtagcgggtctggaagctatcctgaataaacttgatgaccaacaaccaacatttgaagtgcacaacgacatgattggtgaaaaactgcggactttgattaaacaaaaggattcacgggaacacaatttaaatcgattcttcccacaaggaggttagcaaatggatgctttaattacaaacttaaatggaactgaacataagttgagtgacttcggcttccaagtgctcaacttcgaagaatcggcgccaacaatcaccagaactactaagagttttgatgggcgcgccggttcattagattatgggggccggcatgtcgttaagaggattacaatcaatggtttgtattgggttaaaagcctggaacaagtggatgatgtgcgagataaagttaacgcggctttgtcacaaacggaatccatttatttaacacgcatttacggtggtcgaaacttgtatgacgtgcgtgagagtggcaaagactttgtgatggcagcacaaactgttgatgagaaacggtttaaagtgtatcgaacagataccaacctaccatcaatcatcgagcggactggtaagggcgtttactacacctggtcactggaatttgagacagtcgagttgccatatggtgagagtaagccacggtcgcaaacgttagttagtggccaatcaataacttataacggtacagtagcttgttcacagctagaacaggctttttattttgttgtgacggctaaggtggcgtctgctggtgggtttacgttgacagtcgatggtcaatcattgatagttactagcccagtagttgctggtgacgtttatacgttatcgggcatgaataatactcgtggcagtcagaacattaatgataaaactaatgcggggtattttatcctgcatcccagtgcagctaacaaggtagtatgttcaatcagtgcggatgtcaaaattaaaaatttgtgtgatttatatatttaggaaggtgaggtgaaaattattgattaaatttcatgatccggctgggacgccccatttcggccaagctaccattacaagaactactagcgttaatggcggactgtcactgactggtgaagtgtttgccggcggcgacgtattgaacggcttagactacggctggtggttaaacttcgataacgaaaagtacgtcattacgtataagaagctgagtgatgataccaataccgttgtctttgatgcggtacaacagttcttttgggactttgccaaagtagcattgcacgcacaatacacgggtagtcatgagtatacattctatctaggacaactctttgataaatccgggtatacctacaagaatgacgttaccgtaccagcatttgaaaaagaaaattggggttataaaaataagttagatttatttaacgacattattgatcaggctggcgttgaatttgaagtgcataatgagacggttcacattgctaaacagattggtagtgacctgaccagttttgcccgtaaagggattaaccttagtaatctcacggaagaaatgaaaatatccgattttgcgacgtatgctaagggctatggtgctttcaaagatactgaagaccaaagtaagggtcgattagaagttgagtatcgcagtgagttagccaagcagtttggcgacttagaaatggatccgattgtcgatgaacgatacacaattgcagataacttgattgccgccttaaaaaagcaggttgatgcgacctataccgtgtcaatgactatgaacatctatgacttagagaacgctggttatcctaattatgaagcacctaaagtcggggactggattctagcgattgatgaaacattaaatttcaagcgtaagattcgcattattcagcttgaagaacagtttgacgtgaccggtaagcgtatcgggtatacggccacttgtggtgatttgagtattgtggatcagtacacacatctacaaagtagtttggatagcaaggtgcaacgcattcaggaaagtgttgacaatgtagctatcagtgctaacggcaagagttcaaactactatggtgcaaaagaacctgtgagtgccaacgaaggtgatttatggtttgaccaaagtgatagtgatccagacaagtggtctatcaaacaatgggtcaacgggcgttgggagcagattacgttgaaccctggcgaggtagacgccaaagttgatgtagctaaaaaggaagctgcaaccgcggttgaaaatgctaaaagcgcatcagataaagctgaccaacttgcgtcccagtatgatgatacaaattcactagctaatcaagcacttgatcaagcagtaagcgctcaaagtgatgctagttctgcagttgctaaagctgactcaacagcttcagagtttggtaaagttactcaaaaagctgatagtgccctagctagtgccctgaatgctcaaagcgccgctagtgatgcagtaaaacaagcttcgtctgctgccgctgattctaaagatgccaagcaaattgctggagcggttagtcagagttataagacgttaacagacggatcaactatgacccttgctgagctagagaatggcctagctgctaagttgactaaaagtgacttggacggatattccacccagacgtggactcaaaatcagattaaaatgacggctgatggaattaacggaactatgtctagcatcaagaatactgttgatagccagactaccagtattaacgacctgaaggcggactcaagttcatttaagagtcagtttacaacagttaacaatactctaggtaagcaaactactgacattggaagtttacaagcgacatctaaagaactgactactgggttcaatacgttaaccagtgataatacgactaacaagaatgatattagtcaacttaaacagacttcaacagaactcagtagtaccatgacaactgttcaaacgcaggttcaaaacagtgcggttgggactaatctgttaaaaggtactggtgatcatgcagttacaaatacaggaaaaccatatgtctatggttacctttcaaacgaaactactgatgatttgctaaccttatttaaaggattagaagggcaaactgtaactgtatcagttgactatgaatactcaggattcattctcggaagtagtcagaaccgtctagggtttgaaattaaaatagttgcagataccacaaactattttggcacatggtactatcctaataatgattcaggttcaggaaggctgtccaaaacatttgtagtaccgaaaaacataacagaaattggatatgctaatggatatgttcaactttctggttctggaactgggactgtaagtcatcttaaacttgagaaaggtagtttagctactgattggtgccctaatccagctgacaatgccacagtcacggctgtctccaaaatttcacaaactgttgacagtatgaaaactgatatctctaagaaaatcgagcagaaagatcttaatggatatgccacccagacttggactcagacccagattaagacaacttctgacggaattaacggtaccatatccagtgttaagagtaccatcgatggtcatacgactagtattaacgaccttaaggcagattccactgggtttaaagctcaatttacgacagttaacaacactatcggtaagcacactactgatattggtacactccaggcatctactaagtctttatctgctagctttgattctttaaacaccgacaatgacactaataagcataatattagtcaattgcaagcgagtgctaccgcattcaatagtactttaatgactgtccaacagcaggtgactgatagtgctgtcgggactaacctattattgaaaaccagtacagcatttagtatgactggtaataataccgttaaccaatgcgaaaatgtttattcactagctaatgggtacaacgtttcatctttggcttcagcgcttggaacacagtttacacttagttttgattggtcggtttctggtgattcaccttcaggcagtttctatactcaatggaacaacactccatggggtacaaatacaccccagaccacagtatcgagttcaaatacctccggtcatgtttctggtcctttttatgtaagcaccaatagtgcaaatatagcgaatatgattggtcttagactggataactttgtaggaactattacaatttctaatgttaaattagaaaaaggtagtgtagaaactgattggtgtcctaacccgttagacaacgcaacagtcacagcgctttctagtatctctcaaactattgattccattcaaacaacagtacgtggaaaagcggatatgtccaaggtaacccaattggataaccagatcacatctgttgtcggtcaagttaataatctcggacagcgaaacctaatttataatagtgaattaagaactaacactgatggttgggaaagcaatgctaatatttgggtcggaactaaccaatgggatcacgcaaatggtagcaatagtttagtagtcggcacttggccaaaggatcctggaatttggtcgcatgcatacagtaaaatggtacctgcagttcagggaatacaatattcagccagcgctacattgtttataactggagctcaaaaccctacagctactaaaattgaattggaaatagatttctttgatgattcaggtaatcgagttggatcaaatgggacatcgtttgatatttctaaattccaagcttatcaattattaaaaattgaaggggtaactaccccgacaaatgcaaccaaagtgtgcctggctcttcaattgaatggccaagctaacttaatctgcaatcaccctatgttggttgcagattcaaccgttggtgcatatctacctgatactgttggccaatctgaatacagtcaattggcaactaacatcaattttaaggtttctaaagatggggttataaatgccattaatatctccaatgaaggaaccgcaatatatggtaacaagttgcatatcacagctgatacctatattgataatgcaaccattaaagatgctatgatagaaagcatcaatgctactaagattagaactggtacactcgatgctaccaatgttaaagttgtccatttgaatgcggacagtattacatctggtgcgattagaggtgccaacctattaattgacctggatgctggtaacgttgaatttcagaaaggacgtatccattcgtctgataatgcgattgatattaacattgacgataagtatatttcggttgctaatagcgttaatcgtgtaatgttaaaaaatggcgaaatgcaatttgtggaacctggaacttatgacatatctagtaacccatatctacgtatctcaaatacgtttggaggtcaatcaactgaaggtgctgcttttgttggtcgtaagtacgcagtcttggcaaattcagataatttaactggaagtgggatatttgacataacaatgggaacagaaacatttagtggttttgcaactggatatggttctggattcttgaataaagggtggcacatgactaaaatcggtggggccgagcgtggtgttgttatatctggaggcaaagccacgtcgtaccgtcaatactggtctgccagtccttcaattatggttggcgctacacagactgagactggatctggaggtatgcatgggtcaaacattatcatggattgcgactatttgtacaactttagcacatggatgcgaaccagcagtcatgcggctaacgtttatgttgctgatgatggtgccattgttagagctagttctgcttccaagtataaaacaaatatcgaacgatcatttgatattgggatgggtgaacgtatcctagaggttccaacggcgcattggtttgataaagcagaagttcgtaaaaaaacattagatcctcaagctccagatcctcgccgctatttcggtatgattgctgatgatttagatgatgctggattaactgaattagtagaatacaatgacaaaggtgaagtagaaggtctcatgtacgatcgcattgcattgactcttatcccaatcgttcgtaactaccgagaccgcattaccaaattagaatcagaaattaaacaattgaaagaaggataattatgtcaaaaacatcagtacaattaggattcaagaatggtgaattagtaaacgtttatcaagcacttcagggatacaaactcaaggggcgagcatcgttgggccgaacatggctcggaaagcgtcttgctgatgcaaacaaacaatttaacgaagatcgtactgccacacagaaagtttatttcaaaactgatgatgacggtgaatttgtataccaagctgataaaaaaacattaattttaaaagacgactacacaatggacgaagcacagtcaaactttgatcaattagtcaatgaagtgattactattgacgtgagccagtattctgaaaggatcaaagctctctatcaagcactcgcagattacccatacgagttggaaggtcagactgccgaagtgtatgccgttttatttgatgaattagacaaagcatttggaaagggtgacaaataatggaagtattaaacactagcatttcttataatattgatggcgctggcaatacgagttctgtaatcgcaggtatccgtggcgaagtagacggtcgattaactgttacggcaaatattaccatttatccgacagacttagccgaaggaactacgtttgatgacctttctaagaagcaactatttgcgttagccactaagaagctgccggttgcattaccaaagctatcttactcaaactaccagttcttcgtgcaaaatgacgttccggtacgggtaactgcttactctgatattagtgaaacaggcacttatgtgacattaaatgccacattaacttcaactgactttgatggtcatgacgatctcactacagttgggtattcagacattaagaccactgtatcaaaaatcgtagcaaaagaattcccaacatcatcaacgaaagcgtgatgctatgtttgaacatttagccaaaaatagattttggttttggaaagcgatggaaacatatggattaggaatttactttattattaagcacaacacatttgcatttgagccaccacagccaacgctgcttgatgtgcttgatgatccacctatgatttttatgctggcggtggttggaacgcttgctctggtgtattctttgtggaacttgcgtacacattattacaagccattaatgactggatcacttacttttgtctggttatttttcatgatagcgtttagcgttcatgattttgaaatgcaacgttatgtaagttttgaaagtatgtatgccatgtttgttttaggatcaaccatttttgaaattgtaattggggatgattaggggtgagcgatgctgttatcgtagccttgattaccacagcgggttcaatattcgttgcggtcttaacgatgtggaacagcaataaggccgccagcagcgattctagagacaagttgaaaaaggaaaatgaggctttaaaaagggaaaataataataaacaggaaataattgactactatagaaagcgtgataaataatgatggaattaatccaatttattaacggtaccacgattgcggcaatcgccgtagtaacatatctagttgtttgggcgattaaacaaactcaattcagcaacaaatatttaccaattattgcccttggtgttggtgcagtgattggtatttttattggcattgccaatggtgatatcaaatgggtagctggtttggttgatggtgtgattgcaggtgccgtcagcgtcggtggtaatgagctagctaaatcgattgggacaatgtttaatggaggtgcaaaataatgagtttaaatggatttgatgtagccagttatcaggctggtatgaatgtgggcaaagttacaggcgactttgtattagtgaaagcaaccgaggggattgattatactaacccagaatttaatgaacacgcaaagcagacattgtcagcgggcaagaagctaggcgtgtaccactttattcggaacgactcggatattaagcagcaggctgattacttcttgaccaccgttaagccatatattggtaaagcaatgctggttctcgattttgaaaacacgacaggttcaaccattcagaaccaagcaggtgtcggcttagctaagcaatggctggattacgtgtatcaacaaactggtgtccgaccagtgctttatacggggattagttgtgagaactcattagattggtcatccgtggtcaaggccaactatgggttatggattgctcagtataacaactacaacgtcgtgaatggctatcaaccacgaaatttatatggtagtttgaagcattggaagaccgcagtaatgttccaatatactagcactggacggttgctgggctggaatggcaatcttgattttgatgtgttctacggagacaaaattgcttgggataagtacgctaaggctactaaaatggtcacaaacaaatcaattgttaaaaaggcaacaaccaaagatggtgtgtggacaataaccaatgaggttgggacgtttagaccaaatcaaaaacttggtattttcaaatatcctggcctagaattaactggtaagtattacgataaaggtgaatctgttaagtattttggctatgtaagtaatccgcaggctggttacgtctatatcgcttatcgatacaacagcaagctaatttactatgttgcttgtcgagaaattgcctccggtcgggcactgggcacattcgaataaacactagattcccgcactggtctttgttgactggtgtggttttttgtgttttgaatctaattgttttaagctatgtaaacttggcccctcacaagagcgatactaaaagcgatactgagaaaatttaatagagcctaaacgcattggtatcaaagggtttagacgttttactatgaaatcttcttggccgcactaacgaatataagaatcgatttcgataggttaagccttgaaggatcgattctttttttgttgcggtaaattggactggtcacgttatttcaggcttgcttttttgccaactacttcaactatgttcaccaaatttgccgtaccttattgtttaatctcatgattaccagcattataatgaaaacggttaatctactgattacgatattaagagaaggcgaggaccaggcattgattagaatgagtagatggtggtggcgtatcttggtgggcggcttgctggttagcggcgtggtttaccccgcacaagcggccgtaacgacttatccgattacagggattcaggtggtgcagccgcgggtctatcagacgaatagtcagaacggtgtcggttaccatttaaccgtcgtgcgtcatcagcgtgcccaattgcgtgttaatttacatttaaagtatcaccagcatacacagtggacgcgtactgagcaagctaatatttatcgcaacgggcattaccagcgcttttactacgtgcataatggtcgtcagcagagcggctggatagctgctaatcagctaaaacccgccagtacggcgtcggttcaactgcgggtaccactgattgaccagctaccggagttgccaacggggtgtgagatgacagcgactaccatgatgctgcagtatgccggcgttaatattaataaggaacagtttgccagccacgtgccgtgcagttcgaatcctaacactggctttgttggcgatcctgcttcggcctatggtattggtctctacatctacccccaaggcttgttaccaacgatccgccactatctgccgtccgctgtagatctcagtggggtgagcctgcaacgaattaaagtgcagctcgctaaacgtcatccggtagtcgcttgggttcagggactcgatggttttgcgagtcatacagtgacgctcactggatatacaacggcaactattaggtacaatgatccttggcgtggtcaatccggacagatggataaccaagcgtttgagacgatgtggcaattaaatggtcgtcgggcactgagctattaagaaattgataccatagttaacattagttactgtttcataattttatattaaaaatacgctatttgacacacaaaataatcgtttttaatactgtatcacactagtgtatcaacttctagcctgaaataagggcttttagctttagtgtattttggcacggaatttgcatatatataagtgagtgcgaaaaagattgcgcttacagtatcaaaaacataaatagttacaggcaatttagatattatttattcgttttatatgactgtaacgaaaaaataggaggtacaaagatggtaagcattatcattgctagtcacggcgaattcgctaaaggcatctatcaatctggatcaatgattttcggcgaacaagaaaacgttcaagccgttacgttgatgcctagcgaaggccctgacgacatcaaggctaagttagaaaaagccattgcttcattcgacgatcaagagcaagtcttattcttagtcgacctttggggcggtacaccattcaatcaagttaacggcttgtttgaagcacacaaggacaaatgggcaatcgttgccggtttgaacttgccaatgttaattgaagcgtatgcttcacgactttcaatggattcggcacacgaaattgccacgcatatcattgaaactgctaaggatggggtaaaggttcgtcctgaagcattagcacctaaggaagaaaaggctgctgccgctgcaacgactaacaataacgctggccggccagggaagttggaatatgggttagcacggattgactcgcgactcttgcatggacaagttgccactgcttggagtaagacggttaacccaactcggatcattgttgcgtctgataacgttgctaaagacgaactgcggactaacatgatcaagcaagcagcaccatctggtgttaaagcgcacgttattccaattgctcaaatgattaagattgctaaagacgacaagcactttggtggtcaaaaagcattggtcttattcgaaacaccacaagatgcattacgtgcaatcgagggtggtgtgccaattaagacattgaacattggttcgatggctcattcggctggtaaagttcaaccaaacaaggttttggcatttgaccaagatgacatcgacacttaccgcaaacttgaaaaagacggcatcgaatttgatgttcggaaggttccaagtgatggtaaagaaaatatggatagcattttgaacaaagctgaaaatatgttgaaggaacaaaagtagttccaagaatatcagaaaagatggaggattaaatcatgaatttgaacgtaattcaagtgattttagtcgtacttgtatcatttttagctggtatggaaggtattttggatgaattccacttccatcaaccagttgttgcatgtaccctaatcggattagtaaccggacaattagtcccatgtattatcttaggtgggagtttacaaatgattgccttaggttgggccaacattggtgccgccgttgcacctgatgctgcgttagcatcaattgcatctgcaattattttagttttaggtggtcaaggccgtgccggagttacttcagctattgcgattgccgttcctttggccgttgctggtttactcttaacgatcatcgctcgtacgttagcaactgggattgtccacatcatggaccgtgccgctgaagaaggtagttttagcaaaattgacttctggcaatgggttgcgatctgcatgcaaggacttcgtattgcgattccagccgctttgattttggccgttggtgctacgccagtgaaggcaatgttaaacgctatgcctagctggttaactgatggtttatcaatcggtggtggtatggttgttgccgttggttatgcaatggttatcaacatgatggcttctcgtgaagtttggccattcttcgctttaggttttgttttagctgcaatcagtgaaattactttgattggtttaggtgcaattggtatttccttagccttaatgtacttggcactttcaaagcaaggtaactctggcaatggtggtggctccaacacgggtgatccggttggcgacattatcgacaagtattagagaaggaggcaaactgagatgtctgaaactacaaatattactaaaaaagttacattaagtaaaagtgatcgtctgcatgtttggtggcgttcaacgttcctccaaggttcatggaactacgaacgtatgcaaaacggtggttgggcttattctttaattccagcaatcaagaaattatatacaactaaagaagaccgtgctgctgctttgaagcggcatctagaattcttcaacactcatccatacgtggcttcaccagttattggtgttaccttagcgcttgaagaagaacgtgccaatggggcacctattgatgacgttacgattcaaggggttaaagttggtatgatgggacctttagccggtgttggggacccagtgttctggtacacggttaagcctatcgttggtgccttagctgcatcattggctatttctggtagcattgttggaccaatcttatacttcgttgtttggaatgcaattcggatgggcttcatgtggtatacccaagaattcggttacaaagccggttctaagattactgatgacttatctggtggtattttgcaagatattacccgtggtgcttccatgctagggatgtttatcttagcggcgttaattgaacggtgggttaaggtggacttcagtccagttaaagtttcgaccattaagcaacaagctgggtcgtacattgattgggataaactaccaaagggtgcttctggtgttaaggaagccttaacacagcaagctgctggtcgttcacttgacaaatacaaggtaaccaccttacaagataacttggatcaattgattcctggtttgatggcgttgctgttaaccttcctctgcatgtggttattaaagaagaaagtttcaccaatcattattattcttggcctcttcgtattgggggttctgttgcacgttattggttggatgtaatacttgcttatgtcatatttaaaggatggactcgtgggagctcatcctttttatttacaagcgtactttgcataactgacaaactcgccgtataatcggtatgaggatggatacgaggagggattaatatggtgcaatcaatcaatactaaggttgatttagttacgaacggcaattcacatatggggttgaccgattacggtaaaatcatggtcggtgataacggctttgaattttatgatgatcgcaatgttcgtaactttattcaaatcccttggactgaagtgaaatatgtggtcgtatccgtaatgtttggtggccgttggattccgcggttctcttttcaaacgaaacggaacggtatgattactttctcagctaaggaccctaagaaggtgttacgagccgttcggcaatatattgagcctgatcgaattgtaaaatcactgacatttttccaagtccttgggcgaatattcaagggtaagggtaaaaaagataagtatttgaaataatgaccaatgctgccgaagatcctttgtcgacgagttggattattactagttagcttaagaagcttaggcatcaacgggcgggtttagcgcgttgtagtgtctaagcttttttgatgcatcaaaagcattatctgggtacgttaaggtgcgtcataaatggaatttcaataccatgaaacagaaatagttgtactgacaagtcttaaaaagtaactgattcgggaactatggtagaatatagtgtgttatagtgtatcaaaacggatcagctatttgatagtggtgaaaaggagtggcgaagttgaccagaaaatccaagatttgtgaatacgtccgtcaacatagcgatcgacacggactgacgacggaaatggtagcgaccgctttaatgatagcgcgttcaaacgtcagcaaggaattaaatgcactggtgcgagaaggccagttgcacaagctgacagggcggcctgtgcactatgttccggtgaatgcaacagccacaacggccacaacaactagtggcgtagcgaatggagcgacgacagagcgaataccgacagcgcccgtcgcgacgtctgtgcctaaaccggttgtaaatgatatatttgccagcatgattggctcgcatgagagccttgctaatcaagtggaacaggcgaaagcggccattctttacccaccgcggggattaaatacattaatcattggcccgactggttctggtaaaacttactttgcaaacgccatgtatcgttttgcggaaacccaacaagtcttaacgaacccggaaggcctgattacgttcaattgtgccgattatgcgcataatccggaattattgatgtcgcatttgtttggttatgttaaggggtcttttacaggtgctaatgaagataaggacggtttgatccaagaagcggatgggggcatgttgttcttagatgaagtgcaccgtctaccaccagaaggtcaggaaatgattttttatttcatggatcacgggacttattcacgactcggtgagacggcgaagagtcaccatgccaatgtccgcttagtttgcgcaacgaccgaggacccagaaagtaccctactgcagacctttgttcggcgaattccgattacgattcagctaccagcgttcaatcatcgctcagccaaggaacgtttagaattactgaagacattattgtcattggaagctaatcgaatcaataaacagattcggttaacggaggacgtggtgcaggccttacttggctcagtcacatttgggaacgtcggtcagttgaagtcgaacattcagctggtgtgtgcccagggttttgtcaatagcatcgaaaatgacagtgaaatcacaatcacgatggattatttgccacaaaatatccgtagcggtctcatgacagtagcctctaaccgtcacgaactgggggccatctctgagttgttggacccggttctcatcgtgaagccaaatgatggtccaacgccgcttcgtaataagaacgataattatgaattaccatataatttatatgagattattggtgataaagcagcattactaagacgagaaggccttgataaggaacacatcaatcgtttcatcacgaccgatatcaatgtgcatttaaaatcattttataaacaaaatcagttagaagtttcaccagaaaacaagttagccgagatcgttgatcaggacgtcattgattttaccaagacggcgcagatgacggttcaagacatgctaggttataatttcaaggataactttatttacgctgtgagcttgcacgtcagttcctttatcaaacgcatccaggccggcaagcccatgcgtcaaatgagttcggatatgttagcgatggtgcgtgaatatccggctgaaatcaaagcagcggaggcgctcaagcaaggattagaggaacggtatcatttaccgattcccaagtccgaagtttattatctggccattttgctcatctcgttaaaatcgatgcagcttaacggcaaagttggcgtgttggtggcagcgcacgggatgagtaccgcgtcttccatggcacaggtcgtcggacaattgttagatgattatgatgttcaggctttcgacatgcctctcgatatggacccgagtgtcgcctatgatcatgtcaagcgacgagtagaaaagcttgattctgggaaaggaattttgttactagtcgatatggggtcgttaacgaccttcggggaacgaattcagcaggagacgggaattgcgacgcgaacgattgacatggtgaccacgccggttgttttggaagccgttcggaaggctagcctggtcgatagtgatctggattctatgtatcaggagctcgttggtttcaaaggttattcgcgaatttcacggaacctaccaacggatagtcagcgcgcaacagtcaagcccgccttagcgacggataagacggcacaacgggcgattattgcaatttgtgcgaccggcgttgggacggctgaacgtatcaagtcaattttagacagtttattagcccaaaacttcattgaaggcatcacggtatttccaatctcagtggttgaaatgaagacacgaatacaacagatcagtcaaaattatcaaatcattgcggcaactgggattacaaaacccgaattagacgtcccttttatttcattggaagaattgctacaaggtggtggcgaaaagtttattgaccagttagcgacgggtatcgattcgccacagaccatggcggaagaaagtcagcagttgacaccggaactctgcgaacggtacttaggcgattacttcacgtttttaaatcctaagaagttaacgggaattttatgggagtatagcgaagtgattgcgacgcacttggatggtgtaatgacgaatgcttttcgcattgatttgattatgcacttagcgggtgcgctagaacgaacggccatcaaagatgaaatttcggcacccaccgaagagatgccagacattatggcatcgcagtggtacccacttgtgcaacaggccaatcagcaattgacagatcaactacagttaaccttctcagatgctgaaaattattatattgtgcaattattggagactcatcaggcaaaggtcgcgatgagttgatacactaacttggcatgctttttgcatgtatcttattgagtagatttaaccgactgaggagggaaagtagatgttagcatttgtcgttgtcagtcatgggagttttgcgcagggcgttgtcgattcatcctacatgatctttggcaagcaagataaggtccaaacggttacctttcaactggacgaagaacctaatgaattagctgataaattagctgctgcggttgcccggtttgacgcggatgaccaagtcttattcttggttgacctatggggcggttcgccatttaacgccgctagtcggatcgttgccgaacatacagagcgcatgggtctgattaccggtctgaacctgccaatgctgattgaggcttacactgttcgtgataagccaattgatgaggtgattgcccaccttgaagagactggaaagattgggattaagcatctcaagttgttacaggacgatggggaagatgagccgctatgacgatggatattcgtttagcacgcattgatagtcggctactccacgggcaagttgccacggtgtggaccaagacggtcagtcctaaccgtattttggtcgtctcagacgaagttgcccaggatgcacttcgcaagattctaattgtgcaagccgcgccccctggtgtgaaagctaatgtgattacagttgacaaaatgatcgagatttatcaagactcgctatttgatgaagtaaagccactaatcctaactgatacgccccagaacatggcgcgcttagtagcggggggacttgattttagcaaaacgggcattgatattggtagtctagctttttcagcgggcatggtgatggtcaccaatgctattgcaatcggtcaagccgaagcacgggcattatatgcgttacaagcagcgggattaaaggtgtttgcgcagaaagtcccgacggataaacgggttgatgtgatgccgctattagctaaaaatggctttatggcgccagataagtattaacaaagttatgatggacagtggtgtgtcggttatgggcaccactgttctttcattttggctaggtttctaaggatttaccaaaaatacagccgtaaactttgacggataggcttttattgataaaattaaactaatcgaaacggaaagtagcgggggtttaaaaatgccaacttatacaaaattaaccgccatgggacaatatgttccgggacgcgttgttgataatgacgaattagcagccattatggacactagcgacgaatggattcaggcgcatactgggattaaaacccgacactacgcgatgaatgatgaaaacacctcggatttagccacccaggtcgcccagcagttactacaaaaaagtggtttagctgccagtgccattgatttgatcctagttacgacaattacgcccgatgccttaacacctgcgacggcttgtttagtgcaagctaatattggcgctgataatgcgtttgcgttcgacctgagtgcagcgtgtgctgggttcacgtttggcctagcaacggctgacaagtttattcgcagtgggcaataccaaaatgtgatggtgatcagtgcggaagttaattccaagatgatggactttcaagaccggacggcagccgtcttctttggggacggtgctggtggcgcgttattacaagctactgacaatccagatgaaaacagcttgatcgctgagaaattagaatcgcaaggaaacgctacggtcattcactctggacgagtacggccgattactgaagttgccgcaacgaactacccgcaaacggatgcgttttaccaagttggacgggatgtttttcaatttgccacgacggttgttccagaacagatgcgtgggttaattgcgagtgtgcaactgacacccagtgatttacaatacgtgatctgtcatcaagctaatttacggatcattgaaaaaattgcggctaacttggcgttaccaatgacgaagtttccacataatgttgatcattatggtaatacgtcctcagctggggtggcaatggccttagccaatgtttttgataccttaactgggccagtgttgttaacagcatttggtggcgggctagcgtatggctcagtcttgatcaagaagtaggggtgtgcagatggaattaaaagatttagatcgattagttgagaaatacgcgcgacagggttatcagcaaattcgcgttaaagccggcgacttggagattgaagtgacaaaaccagcgttagcttcagaaacggtaactcccgtagccgctacgcctgccagcacagttgcggagactgaagatgaagtcgttacactgccgagtccgatggtcggggtggtccacttggcaccagatttaaaggttggtcagtcactgacagctggtcaagaactaggccagattgagagtatgaaattattcaatccattagttagtccgaccgatgggacgttaacagcagtactagttgctgacgacgccactgttgagtacgaacaaccgttatttacaatgcgaaaggatcggtagctatgtttcgcaagctgttaatcgcgaatcgcggtgaaattgccgtacggattatcaaagcctgtcaacaattgaatattcagacggtcgccgtttgctcaactgctgatcggcatgcgggttacacacaattagcggatgaagtggtctgtatcggacctgcagctgccagtggatcgtatttaaatgccgaagcgattctaatggctgcaattaatacgcacgccgatgcgattcacccgggatatggttttttagctgaaaatgcggattttgccgccatgtgtgcggaatgtggcattgcctggattggcccgcagactgagcaaattaagttgatgggtgataaggcccgcgctaaggattttgcacggcaacaagccgttccggtactagcaggtcaatcattacagggcttagcatggccggatattaaacacgcggccgccaagatcggttttccactagttttgaaagccagttatggtggcggtggcaagggtattcgagtgcttaccgacgttcatgaactccatcaacaattgcgggctgcgcgtcaagaagctgctgcgtcctttttgaacgatgcgatgtatttagagcaatttctgacaactgcccgccacattgaagttcaagtcctcggcacggggacgaaattattcattcttggtgatcgtgactgtagcctccaattgcacaagcaaaaggttctcgaagaaagtccggcaagtattttgactgagacacaacgccgaaccttatacgatttatcccggcagttattagcgggtacacattatcaaagtttgggcacaattgaatacttatttgcggatggtcagttctattttatggaaatgaatacgcgtttacaggttgaacacggggtgacagaattaacgaccggaattgatattgtggctgaacaaatcaaacaggcggctggcgtcacggttgattttccagagcatgttggcttgcagcccaagtgtacggcgatcgaagctcgattgaccgctaccttaccggttaagcagacgcggattgaaacgctgagctggccagccgatgtacgagtggatacggattatcatcagggcgatcggctagtaaccatgtatgatggtttaattgccaagttgatggtcaccggtgcgaaccgtcagcaagccgtgcgcaacttacaacgggccttagcgcaagtagcattgacgggacccacgacgaacttaacttttctacagcaaacggtggcccggccggcctacattcatgatcagtacacgattcacagtctagcacgttgggaggcgtcgaaatgagtcattatccagcttctgggacctggcaagcctgccctaagtgcggtcggcacgtccaccaacgccaatggggcacttatcagcaatgtccttattgtcactattggcaacgactgacgacggcgcaacgattagaacaactcgtcgacgaagggtcgtttcagccgttgacgatgactgagcggcctgtcaatcagctggggttcccggactatacgaacaaactgcggcgggcccaacgccagaccgggttaaacgaggctgttgtctgtggaacggccctgattgagcaacaaccctgtatcttagcagtgatggatagtcattttatgatggggacgttaaacacggcggtcacacgtcgcttattgcatgctagtgaacaagcgcgggcccaacggctaccactgatcattgtgaccgcctcaggtggtgctcggatgcaagaaggtgtttatgccttggtcggaatgaatttgattctggcagaattagcacggttagcagcaacgccgttacccttgatcacagtgctgacagatcccactatggggggcgtatcggcgagttttgcgtttaagggtgacctgattatcgcagaagcgggtgctaagattggctttgccggagcccgggtcatccaacaaactttgcctgtcaagctgccggcggattttcaaacggcggatcagctgtttaaaaatggcatggtggatgcagttgttgaacgacctcaattgcggtcaacgctaggacaagcattagcgaattatgggattgggaggtcagcccatggataaacgattacagcgattacgggcggctgatcggatcagtgcgccgactatcattcaagcgttattgccgacaatgacgcaacaacggggagaccgtttattaggtcaggatgcggctttaacggcgggctttgggcgcactgccactggtcgccaattagctgttctgggcgttgaccggggtgttgatattgcgagccggcgtcgaaaaaacgggggagcattaactgttcccggctatcgcacggcgttaagagtcgtaacccatgcggctaaatttgggtggccggtcgttagcttaatcaatatgccaggtgctgatgcgagtccccgatcggaacgctatggtcagagtcaggccattgcggacttgattgcggcgactggtcagctgaccgtaccgaacgttgttgtatttctcggtgagggccatagcggtggggcgttagcctttgccaacgccaaccgcattatcatgctagatgatgcacttttcaacgttgcttctcccgaggcagtcaccgcgattttacatgggcaacagaccagcagtgacgccatcgatttattaccaatgacagctagcgctttgcagtcgcgcggcttagttgacctggttattgaccatcaggatcagacattagtcgctgcgatcaaccaggcgattgagacccaacttgccgcactagaagcattgccggcaccggatctaattgaacagcgcgaagcaaagtttcaacactttttacaatcttggccggtcaattaaaaataatcatcaaaaaatgggcttctcagaatttttattctgaagaaacccattttttaatagttgcttagtactgattagtcgtggtttgatcttgagtcgtggtctggtcctgcgtcgttgtatcttgtgtcgtactagtgccataagtagtggtatcactagacgttgtggtacttgatgaacttgaactggaacttgagctacccgttgtaattgaagctgtctcagagaagactgactctgttaaattactgtttgagagtcccagcgctttacggatgcgcttcgaattcttgtaacgttctgacgaagaggcaacttgataagagagcccatcgatcgtcgcgtcagtaccttgaacggtatatgatttggcatggtgagacgcattcttgtacttcgtatcgagtgcgaccatgtcattccaagttaagtcggtgcgcatgttcttagcgagttttttcgtaatcttttcaatattggcaattgacccaagtgagttagactgactaaccatggccataataacctgccgttgccgtttttgacgaccataatcaccctgaggatcgtcataacgcatccgtgagtaatcaagtgccgctgcaccattaagtttgatcttaacgcctttcttaacgttggcattaccgtatttgaaagtcagcttaggtgtcacggtcacgccgcccatcgcgttgatgatctgttttaaaccacccatgttcagtaagacgtagaagtcaattggaacatccagtaacttctctactgacttgacggcaccacttgcgcccccaatggtgtaggctgcgttaattttttgtgattgcccatcgatcatcacttgcgtatcccgtggaatactagtgagcgtcatactttcttttttaggattgattgtcgcaacaatcatggtatcagtccgggctgagaagtccttgccgcgacctagtgcaccagtatcagttcccaacagtagaatcgagaatggcttgcccttcttaataacggcatcaacattccgaagcttggtcgagccggtcgactggtaggtcgtattcatcgtatccttagcggcattccaggtcttgtagccccaccagccacccgtaacgatcaacaggacaacgacgattagtaaagtaattaaccaaggacgttttttgtgtggtttcaaatgtgggttacgctgttgctgttcacgatagcggcgttggcgtggtcccatttcattatcattgttattttctgacatattcgttcctcatcactttagatttttccctcaatagtcattttatgacgtttagcaaatcattggtccttaaagttagtaatttaaaaagattttaataatcaaaaaattactagcatcagatagtaacacaattatagaacactataagtaatattgtgaccggcgtcaaacgtttccatctataaattacggtacaagccatcataaaacagtggtatacttgaataattctcattgaattattattttacatagcttgatggcgatattcaatgatgagcaatttgttaagaggggaagactgagcgtgcaaattttacagacattcgtgcagagtattcaaggtgtcatgacgataatcgtgatgattgcagttggttacttgttggcacgctggggctggtttaatgaaagtgcgactaagctgattgcccgattggtcactcaaattgcgctaccagcctatatgattgcaacgatcacaaagcagtttacagcgcataaattattatcaacgttgccaggattacgttttccagttcttaatatggctattttgtttggcatttcgttcggggtgatgcgagccttaaatattaaaaagagtcatcgcggcttatttgcctccatgtttttgaactccaatacggtgtttattgggctaccggttaatcaagccttgtttgggaatagcgcattgccatacgtgttagtttattacatggccaataccactattttctggacgctgggcgtttacttgattcaacgtgacggtactggcaccgctaagtttgacttgaagcagacactgaccaagatcttctcaccgccattactaggatttatgattggcgtcttgcttgttctaggaaacattcacgtcccaaaattcttgatggatgatttctcatatatcggcggtctaacgattccgctgtccatgatctttattgggatttcgatggccaacgccgggttaagcagcatgcgcttcgaccgggatagcttgggaattttacttgggcgttttatccttgcgccggtactgatgacgctgatgcttattccaatgtcgattccattggagatgaagcaagtcttcattctgcagtccgcaatgcccgtcatgacgaacgcgccagttgtctccaaactgtacggggcggatgccgattatgccgcggtcatggtgacagaaacgacactattgagcctgatcgttattccgattttgatggtgatcgttcaagccaactttattcgttaattattgtgtgatttaaaattaaaagtacccgaatgcgtgccactagtgacaggcgtttcgggtgcttttttgctggttattaatgatgaaaactcaatttagttcggtcaacaaggtttgaccaattagatactttctgctcagggctgtcccaacacgtctcgctggtagtttttgatgacaagctgatgagtgcgtgctggatgatggttgaggcggcaagatgccattgaatggttccagcctgatgaaaattgttttcaaaagcaattaaaaattgaaaaaaataacgcctgattccgcgttaaaaggcgttttcccgcggataaaagcgaggtagtatactgagctgatttgaaagtcacgtgaaaatggtgctatactgagaaccgttgtgtattaaattttgattaagaaggaagcgaacgtttcgtgaagaaagcatatctttacattgcaatttcgaccttaatgtttagttcgatggaaattgcgctaaagatggccggcagtgcctttaatccaatccaattgaatctaattcgattttttattggggcaattgtgttactgccatttgcattgcgggcattaaagcaaactggacggaagttagtgagtgctgactggcggctatttgctttaaccgggctagtgtgtgtcattgtcagtatgtcgctttaccaactcgcgattacggtcgatcaagcttcgactgtggccgtattgtttagttgtaatccggtatttgcgctattattctcctatttaattctgcgagaacggttgggtcgagctaacttgatctccgtcgtgatttctgtgattgggttgttgatcattgttaatccggcccatttgacgaatgggctcgggctgctattagccattgggtctgccgtgacttttgggctgtacagtatcatctcgcgttatgggtctgttaaacggggcttgaatgggctgacgatgacttgttttactttctttgctggtgcgtttgaacttctagttttagcttggattactaagattccggctgtcgccaatgggttgacggccatcggtttgcggcaatttgctgccattccggttttggtgaatgttaatctcaactatttctggttactattttttatcggcgtttgtgttactggtgggggcttcgcgttttatttcttggcaatggaacaaaccgatgtttcaacggcttccctagtattcttcattaagccggggttggcgccaatcttagcagcgttgatcctccatgaacaaattttgtggacgacagtggtcggaattgttgtgattttgattggttccgtcgtgacctttgtcggtaatcggttccgtgaacgggatacgatgggtgcgattgagcagccaaccgcggccgccactgatgatgaacatgtcatcaaagccgcgcacgccgtttcaaatcaagaaaattaattaatcgtggacggtcagggtgatattaatcagcttgaccgtttttttgtggcaagtgcgttatcgcacgtaacagctggttgtgactttgaaaaatgaaccaaatcgattatcataggaagtattgaagatagtaggtgggaaagagaatgacagaactagtattggttcgccatggtgaaagtacggctaaccgggataatacgtataccggttggagcgacgttccgctgacggcagcggggattgcacaagctcatcaagctggcaagcgactacgggctacgggactacagtttggcgctgtgcatacctcggttctgaaacgggccatcgttactgcgaatattatgttaagtgaaattgatcagttatggctgccggagtataagacgtggcggttaaatgaacgacattacggggccttgcgtggtcaaaataaggatgtgacccgtcaagagtacggtaaggcgcaagtccaacagtggcggcgcagcttttatacggtaccaccgttattggcgcccactgaactagaccatgatcgacgttacaccaagtacggtgccgccgtcgaaccgcgaggcgaaagcttgaagatggcttacgaccgtatcatgccttattggatcgatgagattgcaccgcggttgttagacggccaaaatcaactcgtggtggcacatggtagtacgttgcgtgcgatgatcaaatatttagagcatattagtgatacggggattgatggtgtcgaagttgccaatggggtaccgatttgttaccacctcgaccagcaactacgcgttatcggtaaagatgagtattaagattagtaatagttcgcctaagtggtgttttttattgagaataattgctagggtgacccacttttaggggtcgttgtcagattaatctatcatgaattaagagcttcagcagccgctggagctctttttttggttaaagcattaaataaatggccggtataactgattataattattaataataattaaggatgagtgtttcaaaaatggttatgatttaaaacattgatatatcagcgttctaatgggcaacaaaggctatataaatatttttaatgtaatacattgaggcaattttcataagtaaatataatatatcgcttgtaatagaatggtgaacactgtaacataccagatgaacaaagttgcgatttggcgcgcttgacagccaaaaatctgatcagaaagctgggtagcgttatgatgaaacataaaaatttattgttattaattataatgagcttgggtttctgtgggatgctgttgatgtttgcgccacaaatcagtacgctgatcaacccgaatgcgtcacgagttgaagcggacaaggctagtggtcacgatacggcgcatgatcaggtctactacaatgatcagatggataactatcattatgactatataaataacgggactaaggttttgaactataaggcccgttttaagagtcgggtcatcacgtatcggatcacaagtgacagcaaggtgtatcgagcgatttggctacgagccgtggaacgttggaacaacactaacgcggtgaagttagttgaggctaaggaccaagcgaaagcccagattacgttgggcgagagtgaagacgagacggcgacgactggatcagaaatcggccggacttggcggacgtactatcagagtggttcgcaaggaacgacttggatggattcggcgaagtgtgtgatttacacgaatcgtttcccagccagcaaccattcggtagaatataaattatctgttgcgacccatgaattgggacacgcgctggggttggagcatgaggataataagagtgcggtgatgtattatcaatcacaccgggcagcgcacatcacaacgcgtgaaatcagtaccctcaaacagatgtataaataattataatagtaattgctataagtaaacgtaataatgaaaaatcgaccaaactcacacgagcttggtcgattttttgatcgcaattgtcagtgatccctgaacggtacctggtctaacggcaacacaaaaacaccgccacttcaacacagtgacggtgcttaaattgcccattaacttttaattaggctaaggcacccattggatcccaaggtgctaaaacagttggttcttcagcttgggcggcctttaagtcatcagataagaattccttgttaacaacgacttggtagcagtattcgtccatccaagcatcgctcatgacgaagaagcccttagtcccaaccttgtcgccccagctattttcaaccttccacttagttggttggccgtcaacgaggtcgacaccggtgataaccatggcgtgggtcatcagactttcgccgtaatcaagacgttcagccttcgacattgaaaggtcaacgtcgaataattcatctttactgtagacatcggtagccatgacccctttttggcggtcggaggattgaccaacatcacaaccaaaccagacactttggccagcttgtaattgcttgatggccaattgcttgaagtcggccatagacacgttcaaatgtttgacttcacggccacctaagacgttacctaacatttcaatcgtgtaggtatggttataaggcttgtcgtcggttggggcgttgatgattgaaacgtaatcgtccaaattccagccaacgtacttttcgaagaagctttgtggcgtcaagttttggtcgatgtggtattgtttcttatcatcacgatattcccagtcaaaatgtgaaacgggttcgccaaaggcataggctaacatgcgatagacttcatttaacatcttttccttgcgttcttgaatcgcgtcgtcactagttccggcagccactagttcacgtaattcaacggcatctttacgtaactttaagttaagtgtgctgttgatttcagccgattttgaactgttgtaagtttcaggcatgacactcttaggcacgataccgtacttctgaataatggcaacgagcatatcccattggccaccatcttgttgtggcgtggtcatcaaccaggcaactttacggctgctagttggttggtcagcggttgccaatacgttttcatagaaatagttcgctttttcgaacttatcccagaaaaaggtgtagttttgtgatagttcgaaatgtttcaagttgaatttttcagctaatgaatgccgcatcgtgtttaaagcggcgaacatccagcaacggccactttgcttttggttcgcaacgtcaccggtatccaaatcaatggaaaatactggtgtggtttggctcatggcctgaatatcttgactgcttgctaagataccgttcttagtgacactacgttcgatgacttttgcttcgggacgttggtccaagtcggcttgaaagttagcaatttggttcatactgattgctttactcaaaagatcactctcctttaatctaattctaattgtatcggtttatgacgggtggggcaagcggggagtcgcacaaaactatggtcgtgcttcgataacctcgggaccattggcatgaccgacaatgacagtgttgaccatgtctaagaacaggccgtgttcaaccacaccaaccatgtgaattaaatcttcggctaaagcgtggggatccgtgattgggtcgatgtgtaaatcgatgataatattattagaatcggtccggacgagttcatcgttgactttacggaatactgggttatagccccgggcagccattttttcaaagacatgttggctgccgtaaggaatcacttcaacgggtaagccaaaggcacctaattgatggaccattttgctttcatcaacaatccacatgactttatcagaattgatggcaacgattttttcgaagagtaaggcggcgccaccacccttaacgccttggaaatcatcggcgatttcgtcggcaccgtcgatcgttaagtcgagatggtcgacttcgtcaacggatttcatcgggataccgagcgccttagcttgggcagcggttcggtcggaggttgagacgccgacaatgtttaaatgttcatttttgacccgttcacccagagcatcaaccatgaatttaacggttgagccggttccgaggccgacctgcatgccgtcttgaatgtattcaacggctttttgaccaacaagttgttttaactgatcctgattcataatatgaattactcctttgattgagaactagtgactaatacgtcggcagcttcagggtgccgatcaaagtaagccttagcgtaggtacacagtggctgaatacgtttgtgttcaactcgagcggcgtcaataacggctttggttaattggccggcaatgccctgatgaccaaagtcgtcacgaacaaaggtatgttcaatgacccaggtttgatcattattgatggcggggaaggtaatttcaccagccaacttgccgtgatcgtcattaaaataaaagcggtgtgcttcacgcgtgaattccattgatttcaccaccttgtaaagggttttatatctaccgtaattaaaccggtaattgcccgttttgtcaacgaaacttctataataaaagtatggtaaaatgtgaacactaaattaatgttgagaaagtaggaatttgaaatggcacggggatttgaaattgtaagtcaatacgcgcaggcggggttacatgtaccttaccgcaccaccaagcaagcagctggctatgacttcgaagcggcggaagattttacgttaccgtcaatttggaaaatgaactttatcaaagtactttggcaaatacatcgtggtgaaccgagttctgcagccgatttggatgcggcggctaaagtccttaagccatggcttgttcccacgggtatcaaggcatttatgaatgacggcgaatacttactattagccaatcgttctagcaatcccttgaaacgtaacttgattctgccaaatgggattggcgtcattgacgccgactactacaacaaccccaagaacgaaggcgcgattttcgtccaattaatcaacatggggattcgcgacgttcacattaaaaagggtgaacgcattgcccaagggattttcaccccttatctgaccgctacgaacgaaacggatgtgaccacgacacgttctgggggcttcggctcgaccaataaataggaaataataaaaaatcggtaaagccaaggtgatttaaaggctttaatgattaataatggtaaaataaacttatgattgtgaacacccatagcatgaaaatgacgattcagttaattgagtttgattgattatttaagtctgcatcgtgctggctgtttgtttagtaagaatcatgattaaaacgtgccgattaggtggattcctgtttgtcagccggtgagcgtcctattccgacctccggggctgggtgacaattgctggaacgtaagccgacgtcgatttgagctaacgcataacccgcgtcatctcaaatacgagtcttattctaagccggaagaaattcacttccgactaagaataatttggctactgagcattgtcacccagcccctccggtctcaagagtgtgaggggccacgggctgaagccgagcattgcctagccaacggattaatgcggttttggcattagtccgttggcgtagcaagcacaggcttcagtggcaccgagcacgtttcggtaagccgctcgaatggctgatgaacgaccacttaactcggtacaattggtcgttggctattttgatactggaactttaaacgaacgttagagttgtatgaaccactttgtcgagatggtcaattattactatgttgattgaggaatagtgagacatcccaatatcattttcaccctgacagttgactgacaaaattactgtttatgaaaaacaatgacaaattcatcaaaagttgggtacatcttcgtccgccattcgaacactgtcccgactggaaggcgtttctgccaatgctcagcggtgaaattccacttagcaagcgtcttgtgcttggttagtggaagaccagtatttaagacgcgattttcggcttaaatctgtgtccaccgcgttccagcaattggcagaaatgcctggaggtcggcgtaggacgcacctaccaaaaaaagtttacgccaacccgagctgtttccagcggtcctaagctggctgcttttgaacttacacaatcggcacgttttaatcatgaatcatgacagtgtgacgcggatgaagtaattattttagaaattccaatacccaacattaaattgatatgttggcggagaaatggagacgtgtgtacgtggcaaaagcaaaaactcagtttgtttgttctaactgtggttattcaacaccgcgatatttaggacggtgtccgaactgtggtgaatggaatacactaactgaagaacattttgatacaaaaccggaccgcaagtcgcgggtgagctttgcgggtaagtcggctaagccacaacgactcaaagaagtgtcgctgactaagacaccgcgtgtcaagactaagttgaaagagttcaaccgggtcttaggtggcggcgttgtgccaggttcactagttttgatcggtggtgatccaggtattggcaagtcaacgttgctactgcaagtttcggggcaattggccgagacgggtggttccgtcctatacgtgactggtgaagaaagtgcctcccaagtgaagatgcgggcggaccggttggctgttagcagtgaagacttttatctttatcctgagactgatatgtcgaatattcgttcaacgattgaatcgacgcatccagaatttgtggtcattgattcggtacaaacgatgcaagaacctgatatggactctgcgattggttcggtatcacaaatccgtgaaattacggctgaactactgcaaattgcgaagactaacggcattaccatttttattgtgggtcatgtgactaagggtggtgccattgcggggcctaagatcttagaacatatggttgataccgttttgtactttgaaggtgatttacatcatacgtaccgcattttacgggcagtcaagaatcgattcgggtcaacgaatgaactgggaatatttgagatgcgaacgggcggtttgtatgaagtggccaatccctcagagatcttcttggaagaacgtctgaaggatgctacgggttccgccatcgttgtttcaatggaaggaacacgaccaatcttagtagaagttcaagcgctggtaacgccaacggtctttggtaatgcgaagcggaccgcaagtggcttggatcataatcgagtctccttgattatggcagtgttggaaaaacgggcgagtctaatgcttcagaaccaggacgcgtatttgaaagcggccggtggcgttaagttagatgaaccggcgattgacttagctattgcggtcagtgtggcttctagttatcgtgaccagcagactcgtccgagtgactgttttgttggtgaagtcggtttgactggtgagattcggcgggtcaaccggattgaatcacgagttggtgaggcggctaagctaggttttaaacgtatctttattcctaagaataatctgcaaggttgggatatcccaactggaatcgaagtaattggagttgccacgctaaaagaagcgctccaattagcattacaacaaccaaattattaaaaaggggctgatgccatgaagaagttaacggtgcgactagtatttattgtcgtcgggggtacgttaggactaacttacctgccgttcttgtggacgacaattttgtcgcaaccaaatgtgttattgaataacgtttttaccaactttttgttgggggcgctgattctatgggttttgtcattgttcttagccaatgccgctgtacgactggtggatcgagtcgaaaagaacttatccaagcaaaatccaatgacacttttatttggcagtatcggatttattattgggttattgatcgcggttctgatttcgcaattatttaatcgtagtccattattcctattgaacacggtcgtcccaattattttgatgttgttttttggttacattggtgcgcgagtcgggactacccggatcgacgagtggcggaaagttttcaacttccgccgtcgtgaaaaggaaacaagtccggagattactgatgctcagccagatcagaactatcatcattataagattctagataccaacatcttgatcgacggccggatttacgacattgtcaagactggtttcttagaaggaacactgttagtaccgaacttcgtcttgtatgaattacagtacattgcggattcagctgatagtattaaacgtgtgcggggtcgtcgcgggctagatattttaaataagctacaaaatgaaaatattatcccggttgaaatgtacgagggcgattttgaggatattccagaagttgatagtaaactcattcaattggctaaaaaagtcaacggtgtgatcgtgacgaatgactacaacttgaataaggtgattgagttccaaaacgtacaagtcctcaatattaatcagttggctaagtcgttgaaaccacgggttattcctggtgaagagatgaatgtcatggtcgtcaaaaatggtagcgaacgccaacaaggggtcggttacttggacgatgggacgatggttgtcgtcgaagatgggaagttttacatcaatgaaaaggtggatgtcgttgtaacgagcgccttacaaacggatgctggtcgaatgatttttgcccgtttagcacacgctaatcgcggaatcccggatcatgcggatggaaataataagcacaacaataatcatagtaataatcgaaataataatcgcgataatcggcactaggttaagcgattcaacggtagcaactcatttgatgggggctaccgtttttttgttcaatgatgactaatccaggacgtcgtaagggaggcggccgaatcgcaacaaaataggagggttaatgctcattatcaataaatcgggatgttgttagtgtacgattagggcctgtttcgatatttttacaatgggttcagtctgaaaccttaatttttagtggtaaacatggtaaactggaaaagcaagtgaaagtcggaatattctggtcgatagaaaggttccggcgtaacatttaagatgaaaaaatacgaaagaggcgttaatcacattggcaaagagcaagattcgtgtgcgttacgcaccaagtccaactggccatttacacattggtaatgctcggactgcattgtttaactatttatttgcccggcataataagggaaagttcattcttcggattgaagacaccgatttaaagcggaatgttaaagacggtgaaaagagtcagatggacaatttgacgtggttagggattgattgggacgaaggtccggataagggtggcgactttggcccttaccgtcaatcagaacggaaatcaatctatgacccgttgattcaacaattaattgatgaaggtaaagcttacgaatcttacatgacggaagacgaattgtcggcacaacgtgaagctcaaaaagcgcgtaaggaaatgccacactacgtctacgaatttgctggcatgacggaagacgaaaaacaggcgaagatcgcggctgctaaggcggctggtatccaacccgttattcgcttccacgtcccagaaaatacgacctatgcttgggatgacatggttaaaggtaaagtttcgtttgaatccaagacggttggtggcgactttgtcatcaagaaacgtgacgggatgccaacgtacaactttgcggtggttgttgatgaccatatgatggaaattagccatgtcttccgtggtgatgaccacgttgccaacacgcctaagcaattgatgatttatgaagcctttggttggcaaccaccgaagtttggtcacatgagcttaattatcaataccgaaaccggtaagaagttaagcaagcgtgacgaaaccgtattgcaatttatcgaacaataccgtgaattgggttacttaccagaagcaatgcttaacttcatcatcctactaggatggtcaccagttggcgaaagtgaattgttcagtaagcgcgaattcatcaaaatgtatgatgaacagcggttgagcaagtcaccagcagcttttgatggcaagaagttggaatgggtgaacaaccagtacattaagaaggctgacgaaaacgaagtctttgcaatgtcaattcgccaattgatcaaggctggccggttaccacaacgcccagatatgagccagattgaatggacacggacgttggtttcattatttaagaaccagatgagctatactggtcaaatcgttgatttagcagatctcttcttcaatggtccggctgatatcaatgatgaagctaaggccgaacttgataatgacacggcactccctgtcttgaaggaattccggcaacgaatcgaagatattgacgtcttcgaagcaaccgcaattcaaaagacgatcaagagcattcaaaaggatacgaagataaagggccgggcactatacatgccgatccggatcgccgtttctcacgaaatgcacgggccagaattaccagaaacgattgaattattagggcgtgaaacgaccaaaaagcatctcgatgctatgattgcggaactcgccaagtaatgaatggattattaaaatattagttggttgtcgtaagtggcggtcgtcgtcagcaagacaacgcaattaatacatcgtgcggtcagcaagctagtccccgggtgagcgttatctcagtatcgcgaaagttacccagtggcgcgtgactgcatatgaaagtatcttttgtatggtggagtttcggttccgccgtgcgagggatgctttttatttgtgtttcaaacatggtaaactatcatcaaaagtaatgattcaattgaaaggagttgtcgccaatatgttaagtgtttttaatacgttaacgcgtcaaaaagaaccgttcaagcctatcacccccggagtcgtgaaaatgtatgtctgtgggccgaccgtttataactatattcatatcggtaatgcgcgttctgcaattgcctttgatactatccgacggtattttgaatattgcggttaccacgttgactatgtctccaacttcacggatgtggatgataagctgatcaaacgtgccgctgaagatcacaccacggtaccagcagttgctgaccggtttattaaagcttttatggaagatacgactgcggtcaatattgaaccagcgacggttcacccgcgggcctctgagaatatcccagaaatcattgcatttgtacaagcattgattgaaaagggctatgcttacgaatcagctggcgacgtatattaccgcgcacggaagtttaaaaagtatggtcagttatctgaccagcgaatcgatgatttagaagtgggtgccagtcagcatactgccgatgaagaaaccgatcgtaaagaagatccaattgactttgcactctggaaagcagccaagcccggtgaaatttcatgggaatcgccatggggtgcgggtcggcccggctggcatattgaatgctcggtcatgtctactaagtacttgggcgatacgtttgatattcatggtggtggtcaggaccttgaattcccacatcatgaaaatgaaattgcccagagtgaagcgaagaccggcaagacgtttgccaattattggttacacaacggttttgtgacggttggcgatgacaacgaaaagatgagcaagtcactaggtaattttgtgacggtccacgatattattaaaacggttgatccgcaagtgctacggttcttcatggcgacgacccagtaccggcgaccgattcaatatacgcaggccaacttagacgaggcagctaataacttggataagttacgtaatgcttatcgtaatctcacgttccggttgcaagatgcgacgaacgggacggatactgcggtggcagaacagttacagacactcatcactaactttggaaccgcaatggatgacgatttcaatgttcaaaacggggtggctgctgtgtatgaattagctaagttagccaatgtctatgcagccaaggcaacggttcaaaaagagacgttgattgccttacagaaggcattagtgcagttgactggcgtcttcggcgtcacttttgaaacggccaatgcgacgctggctgatgacgcgattcaagcactgatcgatgaacgagaagctgctcgtaaagctaaggattttgctaaggccgaccagattcgtgatgatttgaaagctcaggggattattttagaagatacgcctcagggtgtgcggtttagaaaggaataatatgcaagttgattatcaacaattaaacgggattgcactcgcgtacctcggtgacgcggtgtatgaaccgtttattcgccaacatttgattgaaagtggttatactaaggccactaagttgcaccaccacgcgacccactatgtttcagccaaagcgcaagcggcactgatcgaacggatgcaggccgaagaagttttaacgccaactgaagtggacgtttttaagcgtggacggaatgccaagagtcatacgtcggccaaacataccgatgtcgtcacttaccggatctcaaccggttttgaagccgtttttgggtatttacaattgactcagcaggcggaacgaattgcagaactggcacagtggtgtattaaacaagttgatgaagggagggtttccagtgtcaaataacgaacaagaccaaacagcagctgactttgtaattgggcggcaccccgccatggcagcaatcaagagtgatcaacagatcaacaaagtctttattcaaagcggtctacaggccgatgtactgaatgacattgccaagattgcgaagaaacgtaatttgatcgtacagtacgtgccgaaacaaaagttagaccgtttaaccgacaacgccaaccatcagggggtagctgtgggggtggctgcttttgaatatgccaccattgatgatttatttgctgttgctaaggctaagaatgaagcgccatttttcttgatcttggataatatcgaagatccccataacttaggttcgattatgcggacggccgatgcagctggcgcccatggcatcattattccgaaacggcgcgccgtggggttaaccagtacggttgccaagacgtcaacgggggctatcgaacacgtgaaagttgcgcgggtgacgaacttggttcaaacggttaaacaattgcaagaagccggtctgtggatctttgggactgatatgaacgggacggactaccgacagtgggatgcttccggtgccgttggtttgattattggtaatgaaggtaagggaatttcaccattacttaagaagagtgtggacgaaatgttgaccattccaatgattggtcatgttcaaagtttgaatgccagtgtggcggccagccttctgatttatcaaggctacacgtcccggcatccactgggaaaataagatgaaacaacaattattgattgtcgatgcttacaatatgattggcaactggccagaactcaatcatttaaaacaagcggaccggttgccgcaagctcgtgacgagttaattaacatgttgactgagtataaaaaaattacgggccttaatattagcctggtttttgatgcgatgtacgttccgggtaattctaagagttatcgccaagctgatcttgagattatttggacgagtaaagaccagaccgctgacagttatatcgaaaagtacgcgggtgaaaagcaatcgcgagtacttcaagtgacggttgcgactagtgaccaggcagaacaatgggtcatcttttcagaaggtgcattacgagtaccagccttggaattacgacaccgcgtcaagactgcgctgaaagatgtgcgtcatactgccgtgcgcacccaggatttaggtgccgttcgtaaatcaccctggaatgaggatcaattatcggccttgaatcagtaccgccaacaactagaacgcaatcacgttaaacatcatcacaagtcgtaattaggtggttgctgcgagcgtgagttgtgttcgaagcgtcatattaatatttaaattttccaaaagataaccggtgacaatttaaggcttgaaagcagttgcggtacgaaaatgtccggtgattcaatgcacccagttcagctaccgttcaccggatgtcaggatggcttgtcataaccgttttggtgttaccggagcttgcactggcgatactaatggtgattgcattaatcggctgattagacagcgcagtggctgcttgcaacttcagcgcacgcgtgtactcgtcgccagcgggcttaagttgatcgtgcttgtctgtggcgttagtgatattttgatattactaataattagtgcgatatggcactattagattgctgaatggaccaaccgtgttagttttgataacccggtataacgggattcctgtgagtgatgagatggctgaattgaaacgttcgttcgcttgtgacggcatgattaacccggtatagtagcattacagatgctcaggggtgcagtttctgaaaactagtcagaagcgaggaatgtcacgtgaatgaacagcaattgatccacttagcagcggatggtgatgatgcaagcattaatgcattagcccagcagtacgtcccggttgtttggcggttgcggcggcagtactatgtccgcaactttgacgaggacgattggctccaagaaggtcgaattgccgtttatcgagcggcccagaagtatcaacggctacggcagtgtagctttggtacctattaccgggtgctattgagtaatcagattattgatcatattcgccggtcacaggctcgcaagcgccgtccggaaggggatatcttatcactggatgttaatgatgaggatctcttgtgcaatattcagacggtaagggcgtcaactctagaggtggtgcatgttcgtgagcgggtgcggacttttcccacaatctgttcaacatttgaaggattggtttttgcggatctactagcagggcaatcgccagaacgaatcgcatcgagtcggcaagtgaaagttgatcaagtgatcaacgccacggatcggtgccgcaagaagatgcgtgactttttacaagacgctgcctgaaattgacattcgaaaagttccatgctaatgttatacctgatttattatggaggttttgtcgatggcacagaaaaaagttgcactggcatgtaccgtttgtggttcgcggaactacacgattgatgctaacccgaatcgaactgaccgcttagaagttaagaaattttgtaaatattgtggtaaacacacacttcatcgtgaaacgcggtagggggattagatatgcgcttatttaaattttttggtcaagttggacacgaaatgaaaaaagtgacctggccaacttggcgggaaaatcgtcgtgattcgtggacagttgtctcaacatcactgttcttcgtggcgtttttcgctttatttgattggattatccaattattattacaaatgttaacaagctggcattaatggctttttgaacaaatttttgttataataatggcattgaaagaaaacttcgtgcaaacgaggtttttttattttgccaaaagacattttaaaggagaataataatggtcgagtctgttgagaaaagatggtatgtcttacatacctacgctggttatgaaaataaggttagttctaacttggaatcccgtattcaatctatgggaatggaagacaatattttccgggtcgttgttcccgaagaagaagctcatgaagtcaagaatgggaaagacaaagttgaaatgaagaagatcttccctggttacgttttggttgagatggtcatgacggaccaagcttggtatattgttcggaatacgccaggtgttactgggttcttaggatcacatgggcaaggtagtaaaccaacgccattgttgcctgaagaagcggaacaaatcttgcatcaactaggcatgagtgctcggcataccgaattggacgttgaagttggcgaacaagttaccatcatcgatggcgctttctctggcctttctggtgaaattactgaaattgacaacgaaaagatgaagctcaaggttaatatcaatatgttcggtcgggaaacaagtactgaattggacttcgatcaagttgatcagattcggtaattaatttaagtaagctggtggaccatcttggcagaagtaattttagtcatcatcggcgccttagtgctcggtattttggggcgtatcacctttaaattttggcaatacgggcgaccgcagcatttgcggcagtcggtgtcggctaattcagcagatgatagcgccgtgacgctatttattccagggtatgcgggcaaccggttctcttttggtggcatgctacaacgctttacggccggtggcatcgccaataagtcattagtcgtaatgattgatcgacataatcatccccatgtgactggtgagctagacgcttaccgcccaatggtacagttgatttttgccacgccacgcgttgctgtacggcaacaggcggcgggcgtcttggcagttgtgcagtatttgattgcgcatgagcacgttcagacgatcaatttagtcgctcattcgatgggtggtgtggtgctctttcaatacttgacgacagctgccaaactggtcaatttaccggaagtccgcaaggttgtcacaattggtgcgccgtttaatgatagtgaggtcgggcaaaatacgtatccgattgaaaaccacccgttgacggcgaccggaccaactaagactacgcccgtttataattattttttgcgaacgctccaacgattgccaaacacgatttcgtatttgaatattgcgggtaacattggcgatgcggcgcaaagtgatggtgctgtcgctctgaatagtgcgttgtcattgcgctttttactgcggccaacgcgtgaccagtatcaagaatttgtggtacatggtaagaatgcccgccattcacgattacatgaaaactatgaagttgatcgccaaatcgtccagtttttatatccagaagccacaaaaaaggttgctggtgaaaaatagatatgctacaatgatgtctgtgcgtcacatatgcacgtttacgtgggaggagcaaaaactcagctccatttaccacatcacggactaaggaggaatgtctcgtggctaaaaaagtagctaacgttgttaaattacaaattcctgcgggcaaagcaacacctgctccgccagttggcccagctttaggtcaagcaggtatcaatatcatgggtttcacaaaggatttcaatgctcgtactgctgatcaagcaggtatgatcatccctgttgtgattacggtgtacgaagatcgttcattcgacttcatcactaagaccccacctgctgccgttctattgaagaaagctgccggtgttgaaagtggttccggtgaacctaacacgaagaaggttgcaactgtaaccaaagatcaagttaagcaaatcgccgaaactaaaatgcaagatctaaacgcagctgacgttgaagcagctatgcgcatgatcgaaggtactgctcggagtatgggattcaccgtcgaaggctaattcagtactgttgagtatgtcggacacttcatcaaaatgaatgtgtcaagtgggaggaaatctccgtttgaaccacatttgcaaggaggaaaacacttagatggcaaagaaaagtaaacaataccaagacgccgctaagctcgttgatcgtgacaaagcttacgatgtaactgaagcggtagacttggttaaaaaaatggatttcgcaaagtttgatgcaactgttgaagttgccttcaaattaaacgttgatacaaagcaagccgaccaacaacttcgtggcgcggttgtccttcctaatggtaccggtaaagatcaaaccgttatcgtttttgctaagggtgacaaggctaaagaagctgaagaagccggtgctgactttgttggtgaaactgatttagttcagaagatccaagacggttggttagactttgatgtcgcaatcgctacccctgacatgatggcccaagttggtcgtttaggtcgggttcttggacctaaaggcttaatgcctaaccctaagactggtacggttacgatggacgttgctaaagccgttaacgattcaaaagctggtaaggtgacttaccggactgaccgtgacggtaacgttcacgttcctgttggcaaggtatcattcgatactgacaagttagttggtaacttcaagaccattgaagacaccatcgtgaaagctcgtccagcctcagtacgtgggactttcatccaaaacttagttgttacttcaacctttaccccagcggtacgtgttgatttagcatcattttaaggattaaattctgaaaacaattgaccccgtgggtgatctgtgatagattactagaggttaagtaatatctctacctaagactcaggcggcttaacggccttaatctacctgccgaggacattgttttttctctatgtcttggtggacatagggatttttttataaatccctgaaccaaaattctgggaggtgaatctgttgagtaaagaaacaattgctgttaaagcacaagaagtcgaagaagttgcagaacaattgaagagctcagtatcagccattgttgttgattaccgtggtttgactgttgaacaagtaactgatttacgtaagcaattacgtgaagccggtgttaagatgcgcgttatcaagaacaagatcatggtgcgtgccgctgataaggccggatttgaagacttaaaacctgtatttgctggtcctactgccgttgccttctctgaagaagacccagttgctcctgcaaagatcttggctaacttcgcgaagaccgctgatgcccttcaattaaagggtggcgtgatcgaaggtaaagttgctgatcttgaaactgttcaagaatacgctacgatgccatcacgtgaagaattattggctacgatcgccaacttgttacaagcacctgttcgtaacgttgcatacgctgttaaggcggttgctgaaaaaggcgacgaagacgcagcttaatttgctgtcagtgtgttaaaaaaactaaaatataagttcatataaaatggaggaacaaaaaatggcttttgataaagatgctattatcgactcattaaaagaagcttcaatctcagatttaaacgacttagttaaggctatcgaagaagaattcgatgtctcagcttcagcccctgttgctgttgccggtgctgctggtggcgacgctgccgctgctaaggattcatacgatgttgaattaactgaatccggtgaccaaaaggttaaggctattaaggccgttcgtgatatcactggtcttggcttgaaagatgctaagggtcttgttgataacgtaccttcaatcatcaaagaaggcgtttcagaagacgaagccaacgatatgaaagctaagcttgaagaagttggtggtgtcgttacccttaagtaattatttacttaacggaacgtcatcagtaaataagaattttatgttttttgtgaataaatatgaaagaagtgtgacgttcctggtaagaattgttttttttatttgtttggttaaagtaagattatacgattagtttaaatatatctacatatcccggcgctcaatttacaggtaaaagtgcctaaacataccttttagcaccatttatgcgcattaattggtatactaggcctagaaaaactaacgaaatggttgtgattatctttgactcgtttacgaaactctgggttagacttctccgtcgcgacgcttaacttcttggcaaacgtcgggattgtcctaccttacgttctaattctctttaagtatcagcagacccacaacgcgaattacttagccgcaatcgtggtcttctatgtggcccgggcggcaagcgtcttctggaccaagcacctgaacctcaaggctagtagttatttactcatttgcctctggctgggggcattcggtagcttgttgttcagcttgacggctaacattgtggctgtgctggtcggggccctatgcttagggtatacatccgccaacatctggccctattacttgacgatcaagctgcacttgtccgcgcagacggactttaaattaaagaaattttactggttaattttcttagttctcggcattctctttgtcctagattttgcattgaattggggttaccgactggcctttatcctgctggcactactatttatcgttgccttgcctgctggccgtttgctgagtcaattttcactcgcgttttatgatcaacatgaaatggcccaggcacgcccgatcaagccgtggcgcgtggtggtttttatcgtcttctttgctgcgattgggttactgacgttgctgcgtaaggcgagcttgcaaatcgcgctaccagccgtattgggaatcatcgtcgtggccattattctactcaatctagagctagctgctgattggcaagccatgccggctaacaaactacggattgttgatcggggctttttactgagttttgtcctactgtttaatagtttctttggtgtctttgtctttggaaaaatggggatgtacctagtctttgctatctatttgttgggctttgagaccggccgcccactgtatttgttactaggtcgacatgacttacatcgtgcgacaaccatcgcgcgcggtggtttgatcattggccacttattagttgcgacggcccaacccgttttatacgtcgccgggctgcttctgatctcgttgtacgtcggttttgaaaacccagccatcaatactagcgtttatgccactgaggttgatgatcccgatctcgcaattattcataaatatcgcttttccacttatgggggcctactttgtcaactctgtttcttcggcctcttagtaattgttagcagttttcggcaattaaacttgctcaatttcttcaatccagcttcaaccgctttgaagaacacttatctagtagggatggtttggcccttaacggcgatttccctgattgttacgctggtcacgctctacggccagtattatttcaaacgggcgcagtcaaacgattagacaccatctaaggaggcgttacgactatgatttttattgcaagtgcggcaattatcctgccactgattcttctcgggggcctgaatttatcggcgacccgtggaatgaccattagcgctctggtagtgattattactggctatttcttctggcagattagtccaacagttctgaccgcctcaattctgcaggcgattcataaagccctgcccatcttatggatcttatttggcgccttactcatgctcaactgtttgcgcgccaccggagcaatcgaccggatcaaccagggttttcaaagtttgtctgccgacatgcggctacaaaccgttttggtcgccttcctgttcgggggcttgatcgaaggtgtctcaggcttcgggaccccagcaatggtcactgcacccttactaattgcgctcggcttttcacccatggcggccgttatcttggccttagtggctgactcgacccccgcagcgttcggcgccgtcgggacaccattgaccgtgggactgagtaatgtgactgaaaaagcatccgtcttgaacttgattggtctgcgcatcacgcaactcgatctattcgttggtgcgctaatgccagcggtgctcattttaattctcatcatgtggttcggtcctaagacgcaccgcttgaaaaactggctagccgtcttaccctgggcgttagtgatcggtttcgtatacagcctactggcactcctcagtgcttggctgataggttatgaattcgtctcgattattgcgccgctgggaacactgatcattgccatcatcacgatccgatggcactggttgttaccaaagtcgagtcagacaacgccgtggcgaaccaatggcccggtaactcagacggctacatctagttcgatgaacctggtgactgcctggttcccttacctactggtcgttgtactattactcgctagtcgggtcgtgacaccgatcaagcatgttttgactcgttatgctaacttatcgtggtcccacattctgggttatagtcagatcaactctgattgggagctcctctactcaccggggacgatcttggcggtggcggccatcattgggttactcgtacaagcccgttcattgaaacccttattaccgactgcccattcggtcatccgttcaatgggtaacaccgccattgccctcggcgttaccttgatcatggttcaagtcttcactaattctggcctcaatcaggccaaccttcccagcatgccaatgtatatcgccaagtttatcgcgacctatctagctggtatctgggtaatcatggcacctttcctcggccaattaggggcgttcgtaactggtagtaccacggtctcgacgctgacttttgcgcaaatccaagctgatattgcggtcaatgcgagtttgaagcccacgattatcttggcagcccaactcgtcggggcagcggccggtaacatggtttgtgtccataatatcgttgccgttagctcagtcgtcggcctgagtggtcaggaaggcgccatcttacgtaaaacactactaccaggtctgggttacgccctcttaatcggggttgccgggtggctattattacgcctagttgcttaactatatgcgcataaaggcactaatcaaccgcagttcaggtgattagtgcctttatttcatgaatggattagactaaaataggattataattttcaacgcaaaggaggcgctgacatgcaagtgcgcttagtgccgaacttacaactaggtgaacggattattggtccgacccccgaccccgaggccaatcgcgcgctttatcaacgctatgcgaaacgattacaggcccgattaggtatcggttttcaagtctatctagatacgagcgacggttacgatttactacatgcgcgtgactacgacaccgatacttgttgggtcgtcgcagcggccgtttaccaagcattaaccgattccgccgtgctcacccaccaccgcatcatcccgctgagtgaccaagcgctgattttaaaagcgacgcaaccaattgaaaaacagctgcgtcagcccccgactgatcagtagccgccgctcgtcatcggtcacactgatgagaccgggatagctggtaggcatacatggacaccacccgttaaaatcaaaaaagtagcagtgtattagccggttctggctgatgacactgctacttttgtttgtcggctaactgactcaaattaacgagcggtgaacctagttatcgaccgacgcgttatcattattgcatgctggcagccattttgattgccgttgccatctcctgagccttgacttgatagaccactttaccagcttgccattggataacttgatctagctgcccagaacctgacgagaccgcgtcaaaactgatatcgccgaccgattgtggtgctggtaaatagacttgttcaaaggtagcgacagcctgtttcgccaacgcgacgcccgcatcctcatccatcatgttggcatgcacggtcaacgaccagcggccctcgttccacatgatatatcgctgaccggcacccacgtcgatatgcgcggagatttgatgaccgagatcgacggtcgggagccccgctgcggattgatcatcccgataacccacttgcttggccgcggcatccgttgtcgtataagtcgtcttggtgacggtcgcataggccgtttcatccgccacagccgccgcgttgaatggccgtgcttgctgtcccacactataccggacagtgtaattagccgcggcacctgaataacgcatgtttaacttcgaactgccattggttaacccatcatcttgtgggacaagtgcttgttgccccaacgccttagtcaactgttgattaagtgctgctagccgggtggtggccgtcgactgggtgaccgacttgttggaaacactggtggcccgctcacttgctactttagatgaccgactcatcgtagtgtgacgctggctactagtactgctggtggtcgaagccttcttcttggcgctgctgaccgtggccttggcagtcgttgccgtctgactagttgccttggcgtcctgatgtgtttgtgtctgtgatgaacagccgaccaataagacggcgagtggtaatacgagcaagttgcgataattcatactgttcccctccccaataatcatgtcacagctgatacgtgctcgtcagcagcgtccatgaggtttgacttaattatagaatagaatgcgccattaggggtgattattgcaccttacaaaaatcgccggccaccagctggtaaactaattgggtttaccaagactgatgaccggcgttgacgctcaatcgttattcagtaacgtgatgcatacttcgctcaatgactaataaaacgacgaaccaaacgactgaaccgatgactgcccagcggttgacttgatcaaagcacaagacgaccgtcaccgcgataaagaaggtcaaggtcgcgatgttagaaatggggaacagtggcagtttaaagggattatgcgtactgtcagtggttcgtttgtagacataatggcacaccaacaaggcacaccaaacaatgatgaagttggtcgtcgccacgttcgagatcagcgtgaaaacggtacttggaatcacgtagttcagtgcgacgatcaccagtaaaatcaaggacgagaataacaaggagcgggcgggaacgttgtagcgattgacctttcccatccacttcggcgcgttatcgccgtgcgccagcgtaaataacgtgcggctcgtactaaagatggcactgttacaagctgagagcgccgcggtcagaaccacgaagttaataatgctagccgccgctttgatgcccacgtcgctgaagacttgcacaaagggcgactgactggtcgtaatctggtcccagggataaatcgccatgattacgaataaggcgcccacgtagaagaatgagattcgaatcggcaggctattgatggcccgcggtaattctttttcggggttttcagcttccccagctgtaattccgaccatctcgatacccgtaaacgcaaaaataacgagcgaaaacgacatcaggaacccctggatgcctttggggaagaagcccccgtgactgaccaggttcgtcaccgagaccgtttgcccaccgacatgggccgcggagccgatcaagatcgcccccgtcacgatcaaggcaatgatggccacgaccttaatcatcgaaaaccagtattctaattcgccaaacgcactgacggaaagcatattgaatactaataaaatcaaaataattattaaaggcgttacccactgtggaatccacgggaaccagtaacgaatgtagatgccgctcgcagtcaagtcagccatggccaaactgatccagcaaagccaataggtccacccaatggcgaactcgaaacgtttacccaaataccgattgatgaattccaaaaacgaatgtaagcgcgtatctgacaatagaagctcacccagtgcccgcatcatcaagtagcagaaaaagccgccaatcgcatacgccagcaagatcgacgggcccgcctgtttgattgctgacccggagcctaagaagagcccggtcccaatcgcgccccccagcgcaatcatctgcacgtgacggcgttttagtttgcgggcaagttgctgattttccatatgacctcaactttcctttaatccaatttaataataattttcataaaaatacagaatttttcacgtccattcattttatgataaaataatccgccgcgcaacttttgccaccgaaagaaacggtaaaaacggattttaattgccaggtcgctctttttctggtatctttaattactttgattattactggaataccagtcattagagctaaaggagtttacttatgccaactaaaacaactgatactttctggaaacgattcttcaagggcgtcgtcatcgccctcggctttattttaccgggcgtctcaggtggggtcctggccgccattctcggtatttacgagcggttgctgggctttatggcccacttccgccgtaactttaaacgcgacttctggtactttgttcccgttggcttagggggtattgtcgggattgccctgctttccgccccactggagtacttactggcacatgcccaggtgatcgttctctggggatttgcgggtgccatcatcgggactttaccagccttgatgacgacggcgactagtcaagggccgcgcgattggctcgacggggtttggttcttcgggaccttcattatgagtgctggtctactctacttcatgagtgagttgtttgggactttgccggctaactttggtgggttcatcgttgcaggcgccctgattgccttaggcgttctagtgccggggctgagcccttccaacttactgctgattttaggtctcttcacgccgatgctaacaggctttaaaaaactagacatcgtgggcgtctacttgccgatcgctatcggtggtattctggcaatggccttgttctcgaagttgatggatcacctattagtaaagtttcattcccgggtctaccatttcatactcggtatcgtgctggctagtaccatgctgatattgattccaaatccatatgcagctgagagtatctcatacgcgaatgccactctcagtacttacctattcagtgccttagcactcgctgtcggaattgcggtgggttactggatgagtgccttagaaagcaaatacaaataatagcgctgaccgtacgcaaacttgacgagcttcgtcgaatgttacgggacggtcacggattgctataaaaaaactgagtcccagaattttcatcttccgggactcagttttttggtgcgccactcaagcagctgatttaactttgattacgacgtcgccgtggttgcaaccgccgtaattcgttgacttgtgcctgaatctcgcctaacatttgggtttgcattttctgaatttcaagcatgttcggttcatcttgttgaattaaatgatcgaccttcgagtgcaggacccgaatctcctcttcagacatcgagttcactttaaaatcattggccgcttggagacgatcatactcggctgcccggttctgactcatcatgatcaatggcgcctgaatcgccgcgaccatacttaaaaataagttcaatagaataaagggataggggtcaaaatggtggctgaaaattggtaaaacgttgagtagcatccacacgagcatcacgaccacaaacgagatgataaacgcccagctccccccgaaccgcgcgacgccatccgcgacccgttgcccgaatgtcagtgaactttccagttcgttgttcacatcgacgacgcgatacgtatggttggcgaggatcttagataattgcgcattgaccttatcattttgctggtagtcgctctcgatcatcgcatccatctttgctaagcggtaatgcacgagatgctcgctacaaatgaaactactattatgggcctgcggaaagtcctttaaaatcatttgctgcaaactagtttccaattcttctaatcgcatgccgtccacaacttggtaccgttgttgatcgacaatgcacactgctgttttcgccattagacacacacctttctctgatcccggcgcaaaactttcgtgaataacttggccacacgactcggacggcggccctcgccatcacggtgcccacctcacgccatctatttaattatacaaatttaaggcgcgtctgcccagtcaaagaccaccaaacaaaaaagcgattattcgcggcctgaagtgacgagtttcctcgcattcagctcgtcgaacaatcgctgctattagacagagagttcgtccatcaacatcatcgtctgatattgcccgtcatctaagactgcaaccgtctccgggaactcccgttgatagctaactggtaagtcaaattccataatggcatcgtgctgagcgtcaaaggccaccgtgacctggccattccgtgcaatcagggcaaattgcaggacctgtggtaagcgaacgactccctttagatcttgatcaataatatcccaaatgctatcaatcaccgcgctgggtagcttggcggctaggcccaacgttgcaaaccgttcttcatctcgatcgaacatgccaatcacctcattaaatcgattcggcttagttatcgcgaacaatcaccgcaacttctttttcaatccggataaataaaccttgtgaatcctgtcgaaaatcattttctaacgtgtcagacagcggtttaatccggccaaccaccgaaccagttgtgccataaagctcaatcgtctgaccatccgcagcccatttgactgtccagtagctaccttctagggcctcatcgacgaagtactgagtacccgccagcacggcgtcattaatcacgctactttcatccgcagtcatccccgcgtctaattcccacttaagtttttgattgacttccaacatatctcctggaatcaaattctgcatgattattcctccacttttgttcatttacttaacatcataccacaatcataactaatatcagttattcaaacttatcggcagcagttgtctggcaaagattgatatggtactattatgatattaaaatgagattattagaaagtggtgaacaacatggtggctaaatctttagcttggatcaaccttaaacgcacgatttttgcagttatggttatgtcaggggcgcagtctgcccttttttccaagttgaatgatcactagccattgcgaagtcacgagcagctgacgacaatgggtcgtctttttttgtccgcacgtgaccgctaaaggagtctaatatgttatcaccacttacccgtcgtaacctcaccctcagttatggttatgcggcctgtgctttttttggcatcaacaccctctgggtaatttttttacagcaacaaggcctatcactcgttgaaattgggctctgcgaaagtgtgtttcatctcactagttttctctcggaagtcccctctggcgtgatcgccgaccgctttggttatcggccagtcctaatccttagtcgcctgatggctagcgggcacgccctcatcatgttaaccgttcacagtctcggctggtttctcctggccttcatcctacaggcttgggcgtataatctccagtctggaacgattgaagccgcccaatatgacagtctcgtcactgctcaggccacgcaacgttatccacgcgttacgacgattctcaacaccacgatcgaacttgccgatacgttgggcgtcgtgttggccggctggttaatgccgcaacatctcacggtcacctactgggtctacctagtggccgccctcatcgccattctcgcaatcagtgggctgcacgtcccccatcagttgaccaatccgcatgcagaccagccgtcgttacgaacgatttttcgggtggccgcacaactgttggtgacccagcgtcgcttacgatttttgatgctttttgacgcgctcttttcggcactcggcactacttattactattacttccaaacggtgatgaccgcacaacactttagtgggcccctgatcacgacgatcctccttgccggtatggccctcaatatcgtggcgatccaactgacaccgtggctgcagcgacatcaaacccaacatcaattgcttcactggctctgcttaggcatgatcatggccttgctgggtgcgtttagtcgcatcatcggtctcctggtcctcatctacttagtgatcaacagcctaatggcgctgattgaaccgctattttctaactacttcaatcagctgattccaaacggccagcgcgccaccttactgagcgttgctagcatggtctttagtttagccatgattggcgtctttcctctgattggctggctgatccaaagaattggctttgccgttactttcggtagctgtggcctgctgacgttgattgcctggctcagtctctacggctatgtccggcgcgggccaacccgatgacacgcattactgactgcctcacttgctgctaaccaagcgaggcccggcacctcgtaacttttaaatacgggctatttgaccgcggacatcaaccgcaactgtagcaccattaatcatggccatgaacgttaaaataaaggtccctaagaatcgtgtgattcttaggggccttgttcgtccttttgcggcgacagaccgctaagctagtttgagcggaccgggttagcctgcgcgaactgttgccgaatttcttgagcgatagcccgcattcgctcaggtgtatccgcctgcgccagtcgatagccgatatagtatggtgagacgttaaataacggcactactttggccacgacctggtcaccctgtggatagaagaacaggttataactgtcacaccacccatgaaaataggtgtttagtgtgtactggaccacttgctgcaccgcatccgcgaaaggggtaacagcggtgattggcgcagcgacgttgatttcgacaaatcccatgatgggctgatcagaaacggtcacttggacccggtcgaccgtcaacgctggataccccgtcaagttggcggctgtcacgttggcatagccatcgacggccgttaagccaacgatttgcatgtgtgggtgccgtaagctgccacccgaatgcgggccaaagcttttatagcacagcaccgattggaaccggccactcgcaatcgtggcctgccagtgctttaatacaaatgcaaagacagcgcgattttctacgggtgagtaagtagcaatatcgccatcatggcgggcggattcgatcacgatcgtttgccacgtggcttgcaaggtcggaaatttattcaatagccagatacgatctgcatcttgcgcgagaatatcagtcaactggtgcggcgcacaaaaaggacaggcattgtgcggatgccggatattttcgggcttccccttcgcaatggccgtatcaaagattagtggctggtttggcaaggttcctcaacttctttcataaaataagaaaacgggtccgacacactaatcaggtgccgacccgtttgccgcttatacgcattagttcattggttctggtgtatcagcgcccggaccaaattggacatccgccatcgtaatccaaacaacaaattccgttgatgctaaccgccagtactgcgggtccgacgccgccggtagtgattgttcaaagagcgcaattgccaacgcgttagccgcattgtccgcagcaacttggacactcgccccaaaggtctgggcggccggaacgtctggaaaacggacatcccagtaggtgccttcatcacgaaaaatggctggatacttaacttccacataattgtgattcaatttcatcactcacttcttacaatcattttaaggctattataccgaaaacggtcgcaaaagcccagctcaaacatcatgattgccgtaaaattaatcagcttttgacacgtggtacgagccattactatccgtcgtgaccttatagttcccactgattgagttttcgccatagtccttcgcgtcatctaaattatcgtatgtcgagccggagtgactgctactgctgctcttctcagtactcgttgatgacgtctcactctttgatgagctgctggctgttgaagtactgtgagaggtggcactactggtagtcgtttgatgactggccgtcgtgctatgcgaactagctgtcgtattagtggcagttgaactgctatacgcacccgtcgtttctgtcccatctgtgctagtgtcggcatccgtactttcagccgtcgtttcactagtactttcactacttgaacttgaatgcttcttctttttcttcgatgtgctcgatgctttcttcgaagatgattttttccgcgctttgctgctacttgaggaactcgtcgtttcaactaagtcttggttgctagcggctttgacaaagtatacgaccgttcccccgagcgcaatcacgattaaagccaatagccataacgaaacgtgatgttttttttgcggtgacttaggtgcttgcggtttctttggatcgttcggttgcttaggtgcatgggatccctgcgaactcgccttacgtccccgcttgccacccgtagcctctcgcgcttttaagcgtgacatgcgcgtctgtttttgttcaggcattaactatcgcacttcctttcttgcttccgccagtttaccatattttggcgggcttgtcttaatgcttaataaaagaaacaatattatttgtgtcgatttttaatattgaagttcattaattaattgcttgtaaattatcataatagttggcaagcaccccataaatataaggtgtcaaccataactggccgattccaaccgttaacatgctgagaatttcccaacctaaaaagcttaaatgtaacacgaataactgccacttgtgtccgtacatcaaatgacggctacgggtgaccgcatcccgatagcggggacggggttgcccagctggtgttgcggctaacaagtccttatacacataaaaagtctgtgaataagcatacgccttaataatacctggaacgaccaataacaggctccataaaaagatgagcaccgttttataaataatcaaaccgaccagcgcccagccaaagtgcttcgtgaacccgatcgttgagtcgctgactggatggatctggcgttctggttgacggacccagtccaacattgcgtagctcgtcccgatccgaaagatttgaacgaccagccagacaccaacttggaccagtaaaaagccggccattacagctaaaatcagcgatatatcagtacccgtcagtgcccccagctgtttaaaggctgcgctgtcagacgtagaactgcccgctgacatgcgatctgaataattggccatcactccgaaaatcgtcaataagctaataataatacataataagatggcatctttccagcgccccttaaaaagttgcttaatttcagttttaagttcgaccctcgttttttgaatcattgctccacctctccactacttgtttaatctagtccattttccgtgttttgcccctgttagtcaacgcctaaaccctaaaaaagcgccggcaaaaagccaacgctacgggttgaatcataataattgcttatgcataatcacgacgggggcaccatcttcttcatatgggccagcggtgacttgataaccacacagttcgtaaaaacgctgggcagtgagttcaccatgaatctcaccttgagtaaagccacgttgcatggcccactcctcagctgctgtcaataattgtcgtccccgaccctgaccacgataggcctttcgggtacagacccgcccaaagcgcatcacgtggtcagtttgtggttctaggcgtaacgttgcaactggcaaatctggttgcaaataaagaacggcatattcacgctgatcggtatccttgacgtcaaattcaacgtcagcactgatcccacgttcttctacaaataccgcctggcgtaacgcataggcggctgcttgattagctggtgacgttgaaaaaataattttcatgttagtaggccttatcaatgtctttcaaccaggctaacgctaatgatttatcgcctaagtgggcgccaatgactgggccaaagtacgtgatatcaatcggcatgtctggatagatttgttgtaacttttgtttccaatcttcagcggcagccagattattgccctgaacgataattgctcgcagcggatagtcgacttttgactgggcttcagcaaagaggtgctcaactcgcgctaaagctttcttagttgaacgaactttctcaaaggcgacgatttcatggctctgatcatcaaaagtcaacagtggcttgatccgtaacacgctcccaatgaaggctgacgcattcgataaacgaccaccccggaccagattttgcaaatcatccacgataaagtattcgcccatcgaggcccgcagatcgtctaggcgtgccagaatttcttcaacactgtgacccgctttggccatccgcgcggcctcaattgccaaatagcccatcagacggaccgtgatctgggagtcatacggataaagtttgatattatcgaccatatctcgcatgttcatcaagctattataaaaaccggaaatcgtgctagcaagatgaatactgatgaccgcatcataaccttgttcacccaagtgattataaaacgccaccatttcccccacgggtggttgggacgtacttgggaacgacttaaatgatttcatatttgcgtaaaagtcggccgttttaatgtcgacgccttcttgatacacttttccatctataataaccggaatcggcacgacatgaatatcgttgtccgcgacctcttgcggtgtcaaatagctcgtgctgtcagtaacaacagcaatcttcatgacttacacctacttctcatttaaataataacaaatatcatagcataaaactaagttatactctaccttcgaccgtttggaaagtcatggctcgagaattcggctaactgacttatttaaccggttgagtagaatccggagaaggttctgttcatcttggggccatttgtcgaaaacttccgcttcaaaccgttgataatccgcattaatcgtggtcaatgccgctgttcctgccggcgtgaccgtgtaaacgagttggcggcggtcacggccaatcgcttccttgctcaaacgttctttcttgactaggctagccagttgccgacttaatgtagatgtatcaagctgcatggccgtcgccaatttttcttgcgtattggcccccgccgccaactggatcagtagttgccattccgcaacggtgattccttgggccttagtaatttttttcaacatggcagtttgcaacttagcggtttccgctaaggccgttaaacttgacttcatgacagttcattcctctcaacaataattcacatcggtccattgtgacttgatttatcccgcctgatgattaaaaacgtgctaagtttcaaaaccaaaaaatcaactgaactttgctgacacacgcccgcttcagcgcaagctgactgattcagtgcgattccatcgtaatttgcacgctttaatcatcactcatgcgaatagcaacacccacaatgaatacatttgtattatacaatatagagggcgtaattacgactactttttatttaaaataccgttaaagtagtttttgcatataacatttttagattcaaagcgttcatccgctaattgtttgtttgacagccagcagcggcagcgactaactttatgcgtcagcgcggggcgctaacttgtttttaaccgttcaaaaacggtatactagtacccggttaactgtatttttacagtgataacgaatatcttagaaagcgagtgatcacatgtcctttgatggtttatttacccatgccatggtcaccgaattacgccaaacactagttggcggtcgtatttcaaaaattaatcagccataccaaaacgagttgattctgaccattcgtgccaaccggaagaatcacccagttctactatcggctgacccgacgtacccgcggattcagacaacacaaatcccttacgttaatccggccgtgccgacgaacttcgcaatgatgatgcgtaaatatttacaaggtgccatcgtgaccgatgtgtcgcaggtcgccaacgaccgggtcgtgcacctgaccgtgacgacccgtaacgaactcggtgatgccgagacattgacgttgattatcgaaatcatggcgcgacatagtaacgtgatcctagttgataatcagactggtaagatcattgacgtcatcaagcatgtcggtgcggatcagaatcgctaccgactacttctaccaggcgcgacctacatcgagccccccaagcaagacaaacaagacccctttacaccgaatactgattttcacaccttagtcacggattatcccaacgaagacgtgctggcaaaacaattgcagcagcattatcagggattcggccgtgatagcgcgcaacagttagctgctgacttgcatcagtctggcgaccttgatcaccattatcaggcctttttggcacagtttgatcagccgcaggcgacgttgatcaccttaccaaataacaagaccatgtttgccgcggggccgtttgaccattttggcaaagccacgcgccagttcgactcgttgagcagtctgcttgatttttattatgcagatgcggctcaacgggaacgggttcaacaacaagccggtaatctgattcgggtggtcaaaaataatctgaagaagaatcgtaataagctcaaaaagttggaaaagaccttagctaacaccaagcaggctgatgaactgcggttaaagggcgagatcctaacgacctatctccatgaagtcaaacgtggaatgacggagatcactttgccagactattatcacgataacgcgccgttaaagattcagctgtctaatcagctctcgccttcccggaacgcgcagaagtatttttcacgttatcagaagcaaaaaaatgccgttggcttcgttggtgagcagatcagcttgacccaagctgaaattgattatctggacaatatccagacccaaatcgagcttgctagccccgctgacatcaccgaaattcgtgaagaattgacgcaacaaggctacttaaagcaacacaaaactaagaaaaagcagcgcagttcacgcaaaccgagtcagccccaggaatttactgcgagcgacgggacaccgatctttgtcggtaaaaacaaccggcaaaacgatcaattaacattgaaaacggcccgtaagagtgactattggctgcatacacaaaagattccaggctcacacgtcatcattcattcagatgatcctagtgaccaaacactcaccgaagctgcgaaccttgccgcctacttctcaaaggcccgcgattcagcaaccgttccggtcgattacgtccaagttcgccgaattcgcaagcccaatggtgccaagcctggttttgtgatctatgaaggtcagaaaacgttgtacgtttctcccaatgctgagctcgttgaacaactgacaccgcacgcgtaaactagttttaaagtgcgcggtgatcaatcattaaccaacaaaatcgcgcgtccaagatgaaatttctggacgcgcgatttttagtattcactggcagtgcctcagacggtaacggctcaagcttcccgccgccgaaagaatagcaggcctaacactaagaataaaataatgtaagcgagattgccccaaaacaactggacatccgtgagcttagtaattttactcagcgtcggcaatcccaactgggccgaaaagttgaacatgttgagcgggttccacttgagccacgcatacttccggatgagtgcaatcataggaatattgaccatgccaaggacaaagtagccgatgatcccgaccgcgactgctgcgccagaactcttaaacagtgcggccactagcagcaccagactgagcagtagccacgtattaagaaaatcaccaccgacaccagccagccaatcatgccagaacttggcccgcgaaaagattgcgaatttatcattcactaagcagactttgagtagaatggccaacagactgctaccgatatataacagtagactgtaagttaacagcacgagccacttactaaccaaaacgagtggccgtgaatagcgctgggttaacacgtgcttgatcgttccaaattgaaattccatcgtgatcgtcgtggccgccgctgctaccataaagaagacgatgaactgctgcgcttcaaaattagcagcaaacatggttttggcgggaaaaattgtcggtttgatccgcgccaacatcgcaaaaatcagggctaccgcggccaatatcagtccgcagcagatcgtggacttcttcttaaatagtttcgtaagttcttgtcgatacaacgtcatcatagtcgtcaccccctacgcactggtcgtcgccagcaagtttaaaatcgtactttccaggtcggcatcctcgtgctgaacatccgtgaccgtcagtccgtgactagtcagaacatggagcacatctgccacctgatggtcgggtgctaagtggactttcacagccgtgtcggcaactacctgataaccggctgccaccagagcggctttggcctgaccgtcatgatcagttttcacgatcacaaaatggtcggtcgtcgttaacagggtcgtcatcgttgttttctcaataactttgccgtgatcgataatgactaagtcgtctgctaacttttgcaattcactgagaatgtgactggaaatcaaaaatgtgacacccgcctgtttttgcgccaaaataaaatcacgtaactccttagtaccttgcggatccaaaccattcatcggttcgtccagaacaaccaactgaggctgattcaggaaagccagggcgacacccagcttttgtttcatccccaacgaatagtgacgcgctttttgatggatatagtccgtcatatttagtgcagacaccactgctgccaatcgtgcttgagcatcaggcccgtccgcaaacaaccgtaaattgtcccagccgctcatatacgggtaaaggctcggatactcgatcaacgacccgactgtcgctaggattgggtgatgatcgagttgcatcgtttcacctgcgatttgaatctcaccatccgtactaagtaaccctaaaattgctttcataattgtcgtttttccagcgccattcgcgcccacaaggcccacgatacgtccttgggcgcattcaaaactaacgtcacgcaaaactggctggtggccgtaacttttattcagatgtttaacggttagaattgcatcggccatttaaattccctctctttcatgatagcaaacgttttcaaaaactatcgacacattgcgcccccattaaatgacaagtgatcaccatctcggaaaagtcaccatgtgaacgttactgaattatagcccgctattcagttaaatgttattttttggcggcgcacactagtattttggtacggttaaaaccaaccacaggaaacatcgattaactaaccaatcaaaaccagccgacttttgccatgcagcgcgcatgcttgtaatcattgcgtgtgattataagtgaaaaataaggtgactactagatcagctacattaccgatccagcactcaccttatttttcactgttgtgttagttttatggcgccgtgccgtgatttgttcgggtcaataaaccggatgatccagcaccgtccagtccgggtaggtttgatcactgggatcaaactgcccagataacaacacggccttcgccttcaaaactagcggtgacgcattagcttcagtcaacgcatgcaacggcacccgtgatgctccatgcgaatcttgaccatcaaagttagcgacatgttcggccagctgtccagtcgtccgggtcactcggtaaaagaccgccagatgttggttcattcgccactgcttgaactgccagggataccgaaaactcgtgatacccaattgcgtcaattcagtcgggattaacccggtttcttcttgaatctcacggcgaatcgcggcaagtaagggctcaccatcggccaaactgccacctggtaagtcgtagcgattcgtatagggaccaccaaactttttagtaacgaccaacgcatgctcatcgccaataatcccataaacaccaaatgcacggtgataagtttccattgtcccacgtcctttcacgtttaaacagcgtcattaagcgtaagcgctagctatcttggtgtcaaggcaaatctaagtgtttactgtaacagtaaacatatcagacgattttaagtttactattttagtaaacattaattcatcgattgtgtttacaaatacagtaaacagtcttataatcagtaacattggaggtagcctcatggacttaactagtttaacgattgatgatttaaaacgcggctggcatcaaacagccactgcccggtattgtaattactgtgatgctagctgggaaacgactacagcggcggccacgatcgaacaacatttaacgatcgtccatggtggtatccagtcaccactgattcacttagcgagtcgctacaacactttaaccactaaacagcaaaatttactgactgcttttgcgaccggcatcaaggatgccgacttggctaaacaatttcaattagcggcggccacgattcgacatcaaaaatttacatttcgtgaaaaagccaaacaagctaaattgtacctggccatctatcaatccgtctttgagagtggtcagacgcctaatgatttgattgtcctgccagaacaacctggaattattgatgaccgctttgcgattactgaagacgaagtggcccaaacattgaagcagtacttcaactttgatcatgacccactacaattgaagcggtggcccaaaaagcaaaagacgatcgtcacgattctaacgcggatcattgatgaagtaccgatgaaccgaccaatgaacgaagacgagctcaaccactatttacgcccgatttatttcgattacaccacgctgcgccgttacctgatcgactacggcttcttaaagcgtaccgtcgatggccggcaatactggcgcacaactactaaggaggactgaaccatgaaaccagtcgaaaaacatcgcttacaacaaaaatacaaacttgccccaacttattacggcgtcattcaaattaccaacgaacgcaatcataaaatttggattgacacagtgcccaatttacacaaccgctgggccttttatcaactaaatctcaataaaaacttttaccggtccaacccgttacaggctgattggaatcaacaaactgccgctgacttttcatatcaaattctgtggcaaaaggaaacgaccgatgttactaatatgcgtgccacgctcaaagcactcaaaaccaaatggctgcacgatttacaaccattcgatgaccatggctataatcggcgccctaaagattggaaggaaaactaaatgaccaccactaaaccaaacatgcacgccgttgctattaatcctgcaacctggccgcgccaaacttatttttactatttcaccaagatagcccccagcggttttagtctcacggtaaatatggatattaccgccaccctagcctggactaaagcccaccacgttaaattcaacgcggtatatctatacctagtgagtcgcttgttgaccacacatcccgaaatgcgcatcggctatttgaacgatcaactggtgacctttgacgtgttacatccgtcttatacgatcttacacgctgaccggacaatggccaatttatggacgacttacgacaccgattttgaaaagttctatcaacactatttagcggaccaagctgaatttagtgcacttccagggcccatgccgaaaacaccacaaacacctaatctggttaatatcggctgtcttccaggagtccactttagtagctacacgcccctcccattcaaaccactagatagtttctttccaatctttcaggctggccagtttaagaaggacgctgacaaaacaatcatgccgctaagcattacggtcaatcatgccaccattgatggcgatcatctcagtcgtttttttaatgaactccagtcatgttgggaacaaccaacacaatacttagcctaaccatatagttaaggcccgttatgtgcatttgttatccagcttaaacaccgctcgtcaggtcttttttgaagcgaatgagtcactagcttaatcagtgttatttaccggtgtttgttcgctcatcagattgcgcctttcttcaagcaaccacaccgtaaccgctgtccaagtagtgccggccctcgccagtacaattctaagaaattcttatgttagccttatgaaaacgcagtagttgagtctgcttcaaatgggtaaactaaagacattaattaagaaaggaactgatgtctatgcgtcattcacaagtcttaacgatcacggtgaaacaaccgcggcctcggagtgctgatccagctgtcatttatagagtcgatcgccatccttactggcattggaacctaacgaactaataaaaaacgaaccgtgcactgaatcgtagtgggctcaaaggcgcggtattaaaaataatcccgtttgatcagccgtgtgggccacctgatcaaacgggattatttttggttgcaagtaccctgggtatccggtacactgaagccatcaatgaatggaggaaatgccaatggccgagcaccttgacgctgacctagccgttttaacaccgtatctggaaaaactaggtgcaacaccccaccgcgcccaactgattaccttgctcaactgggtacacacgacttttccacaactcaaggcacgggtcgcctggaatcaaccgatgtttactgaccacaacacatttatcattgggttcagtaccgccaaggatcatctgaacattgcacttgaatcacacactttggatagctatcgagacgcgattacggctgctggtgataaagcgaccaagatgttatggcaagtcgctttcgacgtgcctatcaatcacaagctacttaccaaaattatccaatataacatagatactaaacaaaccataacgaccttttggcgcccttgatacaccagcgctcacgactccgctttcataactgattccgggtcgtgagtgctttttaacgtctcaactcagactgatagtcaacgcattcatatctagttgacataattttaatttttatcagttgcagtcaaattaatgattttttcaaatgtgaagcggcccgcgtcatactggtacttgatgactgcacagttatgtaacacgatgccttgccgctcaatttcgtccattgaaagccattgccgcaaaaacatgaagctagccccaccgtgactgactgccaacacctgctgatgatccggacgtgccatcaccgccgtcaacgttttgacaacgcggtcttggacctgcaaatcactttcgccaccgtactgacagaaaaagtcaccatgactgcggcgcacgggatccggttttggatttaacacttccgactcaccttcgaaaacgccaaaattccactctttgataccctttaaccgctcataaggttgcttggtcactaattctagcgtgtcactagcccgttcctgcgtcgagctgtacgcatgatcaaacgtaatcccttgcgcctgaaaatacgcgcccacgcgttgggcatccgcaattcctttgggtgtcagcggcgagtcacacgccccctgaatcttcttcagccgattaaaaagtgtttcaccatgccgcatcatatataacgtctttgccaatttaactaacctgcctttaatttgtctttagataagcataccataaatgaaagcgctatttagagcatcctagaaattagccagccaaagcctacttctgcctacgaacgcgcaaaaaagcacagccagactaaaatctagttgtgctttaaatggcgctattgatcaaaagttcggcctaaaaatccgtatcctcatttccctgattcaacgctgtcaacgccgcctttaacgtgtcgccatgtgcaatcaccgtgccggtagcgtgacccggttcaccggtggcttccacttcatcataaatttgtaaatgattgtagggaaatgtattcgcctgaacatagactggctttagccggttcacatccggatagtcgtacatcaccttagtcagtgcttcacctaatttcacgtgaagtaataagcgggtcacgctcgacccactggccttactgattaacgccatcgtagcaatgctcatcggttcaatcgtagcaagttgcaaggccgtatcagcaatcgctaaccgaactgtatagagcccgggtgcacccatggcgagcactcgttgcttgatttcagcgtgtaaagctgtaattgcctgattttccgccttatcacgaatcggaaatacttggaccgcaccacggacattgccacgcaggttattgcccgcaataatctcactcacgccaaaaatcgtgacatccgtgccatcggtaattacctcgacggcgggcgaatcgttggtcttgatctgctcgcgcggcaggctattgttgatttggatcacttggtagccatcctgtactaacttctggcccagccggtaatcatgataggtggtaaaaacgatcagcggcttttcaatcgctaagacgtttaaaatatccgaatactgtttaggttcaacgtaacgttttttggccaatcgcggcgtcatcgccacactattagggttagcgttgatcaaaacaggctcataatcagcctttttcaagtagaacaacagttgtgagaccaaatagtcgttcccatggttggttccgatccggttagcacccgtgccaatgacaacgactcgccgaccagtagacggttgactttcgttatcaaattcgtacgtggagtaataagtactcgtctgctcagtaaattccccggcagtcggttcgacctccttaaaagtcggttgaatttcattttccaacgcaaagttgcgaaccttagccacatccgtttgccaggcagcggccgcatcttcatcggtaaagccaaaatatttggctcggcccagcgcgtggacgtcaaacggccgttcacgcaaggcgcgttcaatttctaaaatatgactcagtttataaaagtaaaaagcatcaatcttggttagctcggctaattcatcgatttgataaccacgattcagggcttcaagtaaaatcagcattcgcccagcttgcggatgaatcaaccgttggatcagttcaccctccgaatagttctggggtcgattagcaatcacgtgatagcgagattcgtccgtagaccgcaaccccttcaacaaggcttcttccgttgaacgaccaataccgatcactgagcctgtcgattccgtcacggtgtctagttgatgactaactttcttcaacacattaaacggccaaactggtatccggcaaacaatatgatctaaaacgggttcaattaaagctgtttgtttacggtaggcgccgggcagtttgacctctgccaaacttatcccgaccattagattaccaacaacttgtgctaacggatactcggttgcccgcgcggctaacgccatcgtccgatcaaagtacggtgtcactttaatcacgtaatagttttgcgtggtcggatcaagtgcaaattgaacgtgacaagagccggtcaaatgtaacttgcgcatgatcttaagtgtcgctgagcgaaactgttggtattcttgatccgtaatcgtttgcgttggggcaaaaacgatcgaatcagcggagtgaatcccaactggatcaaaattctccatcccactgactaatagcgcggtgtccttctgatcacggacggccacaaattcgagttctttatagccgacgatactctgttcgacaatacattgtttggtccctgaaactttgaatcccattgctagggcccgttgcagttcgtcttcatcttcacatagttggcgactcgcttcgattcggggtgcgaccgacttgacgatcactggaaaaccgacgtggcgcaccacggccatcgcctcagtcgtgctagccaccacttgtgaggcaatcacgggttcacccatatctttcaaccggttgctcatcagcgctgggttgacgatcatgtcgaccacgtcttgatcccactgtagcaacttcacgtgattattttttaacacattgttgcgaatcaacccttgaattagggtgactgtttggacgccaccaagtgaaggaatgaggccatcaggctgttcagtttcaataattttggatagtgcggcgacggtcagtggttccaaataaaccttgtcagcaaaccgattttcagccgccacggagtaagcattgttatcgacgaggacgacagcaatgcccagacgccgaattgccgcaccgatttgggtcaccgcggcatcgtgttgcccctcacggccaatatcattatgcccagcgccgataatcaacactttttgtaaggcttgattgttcaccagattggcccccttgcttgttgcatcgactcaacaaattcatcaaaaatatcgcgcgtttcagtcggaccaggagcgccatctgggaaaaattgcactgaaaacgctggaaagtcccgtagacgcagtccttgaatcgtcccatcgatcaagtcaacaaatgtcgtgatcaacttattacgatcaacagtatccgcatctaccgcgaacccctggccctgagctgcataaataatttggttcgtgattacttcacgaatcggatgattagccccatgatgttcaggtgataatttcataatttgggcgccattggccatcgcaaatagttcgtggcccagtccgatggcaaacagcggcacccgattttgaatgttcttgatcatctcagtcacactggctggtaagtcctgcggtttgcccggcccagtcgatagaatgacgccgtccgggtctaagtttaaaatttcctcagtcgttgccgtataaggtaagaccgtgacgttacaagcacgcttactaagctcgcgtaaaatcccgtgtttgaggccaaagtcgatgaccacgacattgagccccgtccccggattaggaaatggtttcggtgttgcgaccgctgccacctgttgattagtcagcacggtcgcacccaattgatcaaaggcatgggcatctgcaacgtctacgatactggctttcatcgggccacttgctcggagttgcttcgctaagtgccgtgtatcaatatggctgatgccaggaatattttgttgctttaaatattgatccagtgaccagcgccgctgccggttggtcgaaatgctagcgacatcccgaacaacaacccccttaacggtcggtaaaattgattcgtagctatcgtggttgattccatagctcccaatggttggctgcgtaaaagcaacgatttggttatgataaatttgattagtaataatttcttgatagcccgtcatactcgtgttgacgacgatttctccggtagaaaccgctggcgagccaaagccttcacctaaataggcgctgccatcttcaagaatcaaatagcggtctgccattgcgatcccttctcatctgtttgactttgtcgtactagttaataatttcaataccatcgtgaccgtcgatttcattgaccgtcactttgatgcgttcttgacgcgcggtgggaatgttgcgaccaataaaatcagcgcgaatcggcaattcgcggtgaccacgatcgactagcaccgccaaggcaatgctctgaggccgaccgccacccattaaggcgtctaaagccgcgcgaatcgttcggccggtaaatagaacgtcatcaactaaaatgacccgcttatccgccaccgaaaacgttaactgatagtcggttgaaagccgtgcttgatccagtggctgatcatcacgaaatgccgtgatgtccaactcgccaactggaatcgcagtaccttcaagctgttgtaattgggctgcaatccgctgcgcaatatagacgccgcgggttttaacgcccactaagacgacatttttaatgcctttgttctgttcgataatttcataggtgatccgggtcaatgcccgtttcatcgccattgaatcaacaacttctttttgcataattgcctcccaatttgtggttatcgcttttttgagcaacccgtacgacaaagaaagacggccggacaaggtgtcacggccgtcgacgaaaagttattgttaacagtttgcctttcagtctcgcagggccggattaaaggacgctcattactgttagattaatgattcccatcggttttgtcaagcttagccaaggttgtcgtaaagattggtggtagtggtgcttcaaaggtcaataattcacccgttacggggtgcttgaatcccaatagcttggcgtgcaaaaactgaccgtgccccttaatcgtctttttagggccatactggggatcgcccactagcggatgtccaatagattgtaaatgaacgcggatttgatgcgtacgaccagtctccaaccggcaactaatcaaagtgtagtgctgataacgtttcagtactttaaaatgagtaactgctggtcgcccagtcttaacaatggcttgctttttgcgatccttcggtgaccggccgagtggggcattaattgtccccgtgtcctctttgatcaccccgtgaacgagtgcgacgtattctcgcaagttagttttcgccttcagctgggccgccaacgattggtgagcccggtcattctttgcgaccatcaataatccggacgtatctttatcgatgcgatgaacgattccgggccgaaactcaccgttaatcgtcgacaacggactatgatacagtaaggcattcaccaaggtatggttagggtgcccaggagctggatgcacgaccattccctggggtttgttgacaactaagacatcatcgtcttcataaacaatgtctaatggaatgttttctggctcaatcgttgtttgttgaaccgtctgtgcggcaacgacaatttcgtcacctggtttgacgtgatacttgctcgcctcgagttgaccattgaccgtcacctgatccgttttgatcagcttatcaacttgcgaccgcgtccagaccgtctggagtgccgctaacactttatccaagcgccctgtttgatcagtaatcgtgaattgttgttccgtggtcgctcctgccacgttatcagctccctgtaacttatttttcaaaactatcatcccgcagcacgccgatcaagataaaaatgacgcccacggttaaacatgaatccgcaaagttaaaaattggaaaattaataaaatcaagttggaacatatcgacaacgtacccaatacgtaaccggtcaatgaaatttcccaaggttcctgcaatcatcagtgaaataccaacctcatatagccatttgccacgtaagcgccacagcaagtagcccatcacgatcaaggcaatcactgaaatcaagtagaagaaccacatcttgccttctaaaatactccaagcagccccgttattatgtaaattcgtgagtgataataacccggtaacaatactcgtactggcacccaacgcaatatgactcacaatcgctgctttgataacttggtcaataacgaccagcgctaccattaaaattaaatagatccacatattctgtcctcacatttcgctaagctgtgtttaattataccaaaagacgtcgtccttgtacgaaactccggcaggaaaagcgcggtttttattgcagacttaataactaagcacctttcgagtatcctcccaaaagcatcggcacctgattaaccatcccccagttgaagcaacgagcctgatgatcggttgcactgctaagcgagttagtcatcatcggcagggcacaaattaagcctgcgtgattgattcgctgccgcggtctgccaaaaacaccgcaaataaaaagtcgacccccactggcatcgacttatcggtcaagtattagaacaaacctgagatttttccatcatcgctaatgtccatatcgagtgcggccggatgttttggcagccccggcatcgtcagcacattcccagtcaaggcgacaatgaagccggcacctaacttcggcacaaattcacgaacattgattgtgaatccggttggtgcgccgaggcgtttgggatcatcgctcaacgaatattgcgtcttcgccatgcagactggcaagcgatcccacccttgcttggcaaacgttctcaattggcgctgagccttcgccgaatattcgacgttggccccaccatacgtcttagtgacaatatcgttgattttggtcttgagatccgcatccgctgctgacaacggttgaaagtgacttggttgcgcacatagatcaaccactgcgctggctaagtcggttgccccgtcaccgccacgaccccagacgtcagccaagattgcatcgacgccaaggtcggcacaatagtctttgacggcttggatttcggcgtcagtgtcggccgtaaattcattgatggccaccacgactggcaccccataacgttgcatggcgtgaatatggtgccctaaattagccgcaccagctttcaaggccgccacattttcggtcgccaaatctttcaaagccacgccaccgtgtaactttaaggcgcgaatcgtcgccacgatcaccacggcattgggcgcttgtccgaccgctggcacattgatatccatgaatttctgaccacccagatcagcaccgaagcccgcctcggttaccgtatagtcggcgagattcaatccggcttgcgtggccagcacgctgttacacccatgcgcgatattggcgaacggacccccgtgaacgagtgccggggtatgcgccagggtttgaactagatttggacgtaacgcgtcttttaaaagcaatgtaattgcaccaccgacttttaaatcagcaactgtcactggttggcggtcatgcgtgtaaccaatcacgattcgattgacacgttgtttcaaatccgcaatgttttctgaaagacagagaatggccatcagttcactggcgacggtaatgtcaaagccatcttcacgcggtacacccgacgttgcaccaccaaggccaatcaccgtatgccggagcgcccgatcattaatatccaacgcgcgcttccattgaatccggcgctgatcaatgcccaactggttaccttgttgaatatggttgtcaattaaggccgcgagcgtgttgttcgcagccgtcagggcatgcatatcaccggtgaagtgcaaattgatatcttccattggaatcacttgtgagtacccgccaccagtggcgccacccttcatccccataactggtcctaatgaaggttcccgcaatgcaatcatcgttgacttgccaagcttagttagggcatcgccgagtccaatggtcacggttgacttgccttcaccagcaggcgtcgggttaatcgacgttactaatataaggttacgttttgtctgtttgaccggtaacggtaattttagtttagccttcgtactcccatattggtcgatttggtctaccgtcaagcccgctttagccgcaatcgccgtaatcggttctggtgtcacttgctgtgcaatttcaatatccttcatcaattctccgcccttctactttttacttactccattataccaatttttctgaaattatgaacttttcttgtgtgtcaaatgattttattcgtctttagtggctagttgccaggtcaattagctggttacgcgcttttttcaacatcaaaaaccgatattgattgccatcgatttgaactttcaatccaccgcgtatcgggacgatcaattcgagttgatcacggggaatcaccagccaagaatggttcaagaccgtgctaaaaataatgaggttgtggttgattgtgacacgccgcaagctgatttgaatcgcgaccaaggcaataaagagcgccgcaatgacgagtaaccaccacttaaacttcaagatttctagccacaaaataatccccgccatcaatactaacgccgtccacgaccagacgatcacacttgacgctagcattggttggtatttaaaggtatgcttatcgttattcacagtacaaaattcctttcacattggagtgagtttgatgcaattatatacggacgccgcgaccacacccgataatcagcgcagtgccgcgggaatcttaattattgatcagggccaacaacaccaattcaaacaggtcttgccagacagtgataatcataccgcagaatttcttgccgccattgctggctttaaaactttattagattcttatggtccgcaagtcagcgtctttttctatacggatagtcaaatcgtcgccgaaagtgtcgccaagggttacagcaaaactttcagtgtcgagctggcgactttgctgcacctgcaagaccagtgccaattagtaatcacccagtggattgccgaaagtgataaccatggcgcccatcaattagcacaacaaggcttacatcttagtgactaatcagccggggccaaataagtttcaattggtcgttgatactggtcccagttatgagcaccagtttgaacataatcggctaacaacttaccaatcatgggtcctgttgttaaaccagatgaacctaacccgctagctaccaaaatatgtgggttatccggaattggaccgaagaacggcgcaaagtcacgcgtgtaggcacgcgtacccacttttacctgcgtaatttgatccttagtcaggttggcatcaagtttgagcccgctagcaaagagatcatcttcaaccagacttgaaacctgcaaatcgtagccctgatcattttcgtgcgtcgccccaacgaccaatttgctgcgcgtaaagggaataaagtctcgttcaccctcaggcatgagcactggaacatcgtcagcccaagtctcaggcagctgcatttcaatcaactgccccttttgtggccgaacatcagcaacaatcttcattggcaacaataacggctttagccacgccccgactgctaaaatcaacgtgtcatagctttgctgaccattaaccgtcaatagttggccctggtcacctaaacgtaccttacctttatgacggaccaggttccgcttttcagcgtatttcagtaaattatgtgcaaacttatcgccatcgacccgcgcaccaccactcacaaacacaccgggttggggcgctgttagcagtgggatccgttcttggacttcttcagcagttaatttctcaatcgttcccatctggggtgccgcttgccggcgctttagcgctaaatcgtatagcgcctgcaaatcatctggatcggcacgagtcacaatcgttcctgcttgttgataaacagaatagcccatttgcgtgtccgcaacaatttctggatataaagcagccccagccttagcaagctgataccaacgctgattacgacgcttagataaccaaggtgaaataatccccgctgaattcttagtcgcttgaccaataccttcatcataaatcgtgacgttcaggtcagggttctggcttaaatagtacgccgtgaccgccccaacaatgccactaccaataatcgttacttgtttttgcattttccaacgcctccacaaccaatctgctttcattttagcatactcgaattttttgcgggtggctgattcagttggattaaaatcagatcattcgtaaatgttgctggcacgagctttgcggcaattaatttaataccgtggactggctctttgccccttatgactgagacagggcaatcaatagttgttgccggacaaaattttcgttcgtccagtgtaaataatgctgacctggtgcatgaaccaagtgaccaagctggcaccacggtgattgttggtacgccgtcaagcgttggtcagtgactaaaacttggattggcagcgtcagtacccgcttttcagcggttcgaagcgtcgttactaattgtggtaagcattgcgcttcagtcagaatactcgggttcgcgtaagctgctaaatcaatacgggcattggcgacacgttctgccagtaggtttaaaggattaacttctgctaagagttgctgaagtgtcaaagtttgtcgctgttgtactagttgcggatagttttcaataaaagattggacgtttgcaagaagttgtggtgccatcgcggcatagggtggttcaagcaaaactaagccacaaacattatctaagtgctgctgggcatataagaatgcgtaactagcgcctaaactgtggcccaccaataataagttgctcacgtgttcatggtgaaccacatcctcaagattggctaaaatatgcgggacagtgcgcaccatttgactatgaatgctacggcccacgccaatcgtgtcgatggcaagtaatcccacctgacttggcaatcgtgccattaaatgcttaaaattataatcagtggcgtcccagccaaacgccggtaagcacatcaacgtcggctgttgtggtcccgccggtcggtactgatagtacacttgtcccaattccgtcattaattgattcatgattacttgcctcccacaatgacagacatcgtaagtagttccaaatgctttttgtattacagataaaacacagctttacaatcagtcatgcatagtctagtccacaactgatcagtagaaaatggtttttaaccgcttcgttaaatcaactgaccattaaaaaagttacaagatttaaataatcgtcacattttgaccatattttcgttttacacttattaatatgcacgactatattgttttaaaggacttttgccatgttagttattgtttggattcttttagttttattgttaggactcatgggttggttggaataccacaatcttcagcatccggtcatccagccagctaaaaccctggcgccgcgcgcacagctccaattgcaacatcaagtgcggcaacacgtgaccgatcaagcaccacgattgaaatggttatattatggaatggcagcttgctggtggctcggtgttatcagtttactagtcagttgctacttggtcagcgcaaaattaaccctgttgatttttccgattcggagtgttgtcacaagcatcgccttaatgatcgttggcattatcttgctaatgattcccgccttagtgtggccgacgcaaagttatgattacttgattggtcactcaactcaagaccatcattggcagctagccgataccgccacgtttgaacactatcgtcgctttcagatttggttggttttggcattagacgtcttcatcctgattggttggattagttgggcctaccgggtcagcaccgttcccatggtcactattgagtacctactaatggtggtggcaatcgccgtaccagttgtggcattgatcacgctgttagcacaactgccatacttacatcaaaaccgatacttgattccggtcagcgggcgctttggcacccagcattatcatgcgaatcaggcactcatgcaacaacaaccggacttaaagtcacggctaattatcgttaatgttgttcggattattggttacgcgttggggttgtatgctttatggttgttatatgccaacattcttgcaccggcctttacggtcgataccagtatcgtttaccccgcagcggcgtttgccatcatcggattgttaatcgtgttaacagtgggcggtgtgtggcttccccgtttctatgattacttgcaattattagataacaagaccttgacgttcaaattggccggtagcgaccgcttccgtcgttttcgttttcatttgtattacttcaagttggcattcagtattttatggatcgttatctgggcattgatcatcggttatatttattactttggctaggtacgctcaccaataatacgcaaaacggtactcaaactaatctgagtaccgttttttagtgtcattttatgagacttgccagcgaggccaacttgagcgccaaaggactcaaaataagtgtcgccattgcggcgcaagagccattactgttatattactgcgttttgaagagcgcaacaaagtcagcttgcgcgctcgcagcttcaaacgttcgcttggacagtgtcgtcacctgccgatcattgagccacagcacttggtaatctgtaaaagcatgaaggtcgcgaacgtcatgtgtaatcatcaagtaggttcgctcaggatgggcttgcatgacctgaaacaacaactgcacgttttcccgatcgaccgctgctgttggttcatccaaaacaatcaattcgcgatcaacttgtaagaacagcaataactgaactaatttgcgttggcccccagaaagctgaccataatgctgatcccataacggggccaagaattgataagcttggggatcaataagttgttggagctgttcagttgtcaatcgtagtcgtccgtgctcgatacccaaaaccagttgggcaacgtcccgcacacgaattgaagacagtaacgggagttgttggttcaaataaatggctgctttaggtaggtctaattcaccttgtgccggccgcaaaccagtgataatatcagccagcgtcgtttttccagcgccattttgaccaatcaaaaaattgacaccgggactttttaattgaaaactcacgtccttgaagaacggttgcccatttcttgaaaattgatatgctaaatgctcaacacgcatcattataagccctccgttggcagaatcttaatgtgccgatagctaagtccgcagataaccaataatacgatcagactcagaagataagtcgtgataaagtggctgacggggcccatgctgatcatcgcaaagacattagtaactaagtaaatgggactaaccaggttgagcaacgggttactggcagacaccgccagcatgttactcaacataaaggtccccacgacgacgatcagcgccagtgcatttacaatcgtatcgacagttttacggcggagcgccaaggcaatcaagggtaagccaaaacaagtgactggtagatacacaagcaacacggtcaaccataagcggcctagcaacggtaaaaaggccaacttgaaagtgatcgcgctcaacagggccaccaacaataaagtcatcaaaattatgcccaagctgaccagcgcttgactgacaagaaaaactgcggggctaaccaccaaggttcgatattgtttgagataaccctgctcgcgaagaatggctacactgctggcagtcgttagacaattggaaaaaatcatccaaccaatgtagggcacgacttgagccgtataagttgtcagcgataaaggtttaaagaaagcgctactgacattcatgattaaaaagacaagtggtaaacagatcgtgtaaattaacaccccgggagtatcccgaatgaccttaaaaaaatactgcgtgtagacccccacctgaacgctatatttattcatcaccatcacactccttttgttaatctaattgttttattatatgtttatcatttatcaaaaagcaagtattcttataccagacatgtaagtatggccggtttacaaagtttttgagcttgctaaacgtctttaattgcaaaaggtagtctaaaaatgactaaacgtcaccgttcgagcctgcgcatcaatccggacatccgcccccaatggcgtactgagcatggggactgtatggcagctatcgtagtcgtaaataattggtaattggcgatcccccagcacctcctgtaagatatcgattggcaaccgcccgctgccttgatcatcgtacaacgcgtgttttcccaaaataatgccagagatttgatcaaaaaccccagccaacgctaacattacgaaatttttttccagcgttgctgcagttttctcggcatcttcaataaataaaagctcgttaccagttaattttggaaaataaggtgagttaaagaacccgtacatggtgttcaagttcccaccgatcaaacggccagccaaaacaggggttgccgtataatgccaagtatttgcgtgcatgtgtttcggatgctcaaaggtctcccaattgaccgcttcatccgtccactgtgccggtgcctgctcgattacggtctgccccggtgctgcgcggtagactgtcagaaaattttgccaagtggttgtcacgatctcttgttccatagcaccaagtgaggctactaaggcggggccgtaaatcacccgacagttaggcgcgtgcgtttgcaccgccaataacacggccgtcgcatcggagtaaccgacaattgttttgggatgctgattgagatactcgtaatcgagcaatgctagcaccgaatttgcgttcgtcccaccaatcgttgccatcaagatgtccagcgaatcatcatgaattaacgcgttgatttcggccgcccgttctttgatggaaccagcacggtaactatcccgttgtcccgtcaaattaccggcaactaaggtcactccttgggttgccaagaaccgtcgtgcgcgagcataacggtttggtgataatgccgtaatcggcgttgatgcagaaaatgtcccaattttcattgtattcccaccccgtaagattaaaatgtaattaaaataagtgtagcactttttaatctttctaaattcccaatcgacggatttcgtcaaaaaaacgactttcagctaataacttgctgaaagtcgtttagtaatcaactggcaatgctcgtattgaacgacctagtcgacttattgcgtgaccacgtttgagcggttggctgaaacgtaattccctttattcgttaaataatagcgtgagccacccgagcgtgaataaaccttggttactttaattcgatcacccgcggcgtggtaggcgtgtcgattagacttgacaaagtttgaagatttataggtgtagagccccactttagccttgatccagccactggaaggtactgattcatagtaccaatgatcagatttagagaccttcgccgtgatataacctccactcaccttaatccgatagaaattcccacttttaaccaaattaccactgtagatgccaccctttttcaaggttttacccgttgaagttgtcaaattgacatctttgaacaaggtgctcttttcacgaagcttatacaaccgatgttggccgacccaatagccggtgacgtcctgggataagacccatttattcaaaccgcttaagtaaactaactgtttggagcgactcttggtgactgacttggtcgctgtgaccttgtagtattttttcttagcgctagtaggaactttcgtgccgtcataatagctcgacgccccattattgaggtacacatgctgccctttcgtataactgctgtaggcatacgtcgtgctagttgaactagtcgacgatgatgccgaagtcccggaagtccaccagcttaacgggtggtaggtcgtcacggaagcactgtcatacaaactgttatcaacatattgtcctagcgaagataaataatagctactggaatattgccacaatgagaacgaaatcgtcggcttcgaggagtaatttgcaatccactgggcatcaaaactttgccgtgccgtgttggcgtatgtggttgcaaatgactggtacgaataaaaaatcaacttcttgctcgttaacgaccgcatctcagtataccaagccttgacagccgcgttggccgccgcgctactcatggaagtcgtttcaaaatccaagacgtagaacttcgtgttcttatttgcgcgttgatagaacttatctgcctcggctttagcagtcgcggtactcgtaaaggtcgcatagtcataggacccgaacggaacaccatatttcacatagagactctcattagaggtgtggtagagatcctcataactgctcccatattgcacccggttaatgacaaagtcagcctgactcttcaaactttgaacctcagtactcgttaactgaccttgccactctgagatatccggcaccgccgcgtgtgcctgaacgaccccaataccacctaaaaaacaacccaagagtagcagcatcaaccgccactttttctgcatgaccaaattactcgccttcccatcattagtttgatatgtacgtttactgcacaccttatcctaccgataaaatgtgcagaaaggttctcaaactgattgcagtcgttttacaatttgtttacattataaactaatacaggaaagtgtgatttactagtggaatgattcatgtggaaacttttctaaccgatacagaccttcatcatccgggtagctttccccaggcttagggcaatacccgaagtgttggtaaaataagtgcgcagtcacggacgctggaacttctacacggtgggcgtgactgaaatagatatcctgttcaagggtatgcagaatttgacgaccgccgcccatgccctgaatcgcaggatcaacaaaaatcgtgaacagactgtactcacccggacgcccccagtacgacccaatcgccccggtcgcgacgagttgctgctgaaaatagccgacataaaagtgcgtcgcagcagctttttggcatagccaatccggtgtcatctgggtaataagccgatccaagtatgctttaggatagtcaccctgattactcgtcagtaatgtgcgcgcaatcagtgccgccgcggctggcgcatccgtagttttaaaacgtcgaacttgtaattgcatatgacaactcctctcgtattgcactattctttgattgttgcaatgaacaaagaatgtctttttgatcgtctgccgataccaatttgtcaatgagcacttaaacttccgcaaaccaaggttctaaaatttttaacgtggcttgatcaaaatcgatacacacttgcgccccatatggaagtgccgttcgcggaaaagcgtgaccaaaattaatattatacagaattggcaatttcaaatcggctgtctcatcgatcaaaatttggcggtattcctgataataatgctcattctgcggcttacctacaatcacggcggagacgtttgtcaaaatctcagcttgtcgcattcgttgcagcatccgcttgaacaaatcgggctgcggctgttcgtcactcgtttcgataaacagaatttttccgcgccattcggctgcagatggaatcagtctgaactgttccgcaacttgccgttcgtctggataacgggtcgtggtcaataaatcataaaagctgtccaggcaaccaccaagtagcgtcccactgattgtcccgtgaccacgtaacacttcgtaatggtgcatttcggtgtgggtcatgcgccgcgttccctgcgccgattcactgaaatctgttcgttcgtcataccacacgggactgctaataatgcttgtctgcgacggattttcaaagtatcgctgccaagtatttgcagtatacggcaacatctgcggccctaattcggccaaatcgcttaaaaaattggggccataaaaagtttgcagtcccagctgataaaacatcaaatgattgatcgtcgtatctgaaaagcctgtgaacagtttaggcgagcgccgaactgccgttttaaactgctcgtcagccatcaaaaatggcacggtgcgatacgtatcatcaccgccaattgccgctacaatcccccggatacttggatccagaaaggccgtcttcaaatcggcggctcttaaatcagggcgttgctgtaaaaccagtcgccctttcaaggcattcggcatcatgactgggacgagccctagttgtcgcatccgctttagcccccgattcaattgatgttgctgcgtgagttctccgagcgtcccgctcgaaagactgacgacggccacgtgatcaccaacgtgcaatggtgctggttttaacatatgctcaccctttcttaatttaatttaaaattaattttgtcatcattatataacattttaaattgttactcggtttttattcattttcaatgtagccacgactaaataggtcactgagtccgcaactctgcatgactcagtgacccgtcgccctattgtaaccaatcttttatgtcaaccaagcgaaacttatgcgtacccgctgaccatcgttctggctgtgccttaaccattgccaacaactctgtcagtgtctcggaaccaccaattaactgttgcagtaatactgagaccagtggggaacgtggttgcgcaccaactaataaacaatgttcaccttcaaaggctaacacgtcacctcccgcccgtaaacggccaaacgggcggcgcaacctgacgggacccaaaatcagcaagccaccttgttcaaataacgtttgcaacaccaataatcgagtttagagtggttagaccgttgtcgtaaatcggctggcaatgctttagctaccggtataatcgttttgaaattccgactatactgatgccacgattgaacccagtcctcatgctcacagataaatcgccggggtaatgtcaattgacctgcataatcacaaatttttttaatcgccggatcactcattattgacggactggcttcaaaagtaggtcgcaattgtcgtatcagttcaataaactctgctcgataatcggcaaagcctggtgttgctaaattaatcaaaattcgcttagcgacgcaataagtcaccgcatcctgatacgtcaccttggcgtgctcaatggcatcttgataggcggtcataatatcaaacagtcgtgggttggtataatctaaagttgtcgaaccagcgtgtttataataattataaaatggttgttgcacataagcgactcgcgcacagcagctcaacatgtccagcaaaatatctaaatcctcgtagaccatccgctgataacgatatttctgccaacacgaacgtgcatataatttatttccggaataagcattatttagaccgtatttaagataagtcgcaattgccacgtgatcagtcgcatctggcaagctcagcagactagttgtgcggtgagtcgccgcgtagattttacgaacatcacaaacgacgatttgggcatgactacgctcagccgttgctactaaggtcgcatacatcgtcggttcgacccaatcatcagcatcgacaaaacctaaatagcgaccatgcgcggcggtaatccccgcattacgtgcaggtccctgtccttggttacgtcgatggataacccgaaataggtgcggccagcgctcacaatattggtcacaaattgcagccgtgccgtccgtactaccatcatcaacaataatgacttctaaggccgctaatgtctgtttttttaatgaggtcaaacaacgccttaaccagtgctcctcattatacgcagccacaataacagaaacttgaacttgcatactgattcccccaacgatcaaaatgatttcgcttacattatgacacacatgcttcgcatatcatagcacggatccatgataaggataatcatgcgcagtcgtggtctgatactctcgtaaatcgtcgatccgtcctgctaaattaaaatgaactgccgaaagcccatcaaactgagtcatccggtcggtaacagcggtgaaggaccactgggcaaagatcatgttgtcagttgctgaccacaaccgctgaatcgaccacgccgttacccgttgaactcttaattgatgttcaatccaggcttgaacttccgctaatgatagatatgctggtccatagcattcttgataataacaatcgaccgcaaatattcttggtaacgcttcaaaatcacgagtgacccacatcccaaaatattgctggacttttgcttttcggtcccgaagtagtgccgtttcgattgcagtcatttaaaacaccttccgttttaagattactttttagaggccgtaattctagttaataaacaggcgattaccattattttaacatcactaacaattaacaagaccaaatattgactaaacaagtctatcagttgtattcagcagtcgtttctggcacagttaacttaatcataatattaataaagtgagccgataaatatgatcaaagttactaaccgacactttcaagatgtgcctgcgctggaagttgttactacaacccatttagaccaaccgctgccactagtgattttttaccacggttggcagtccaataaagaactcgtgttgacccaagcacgtaaactggcgcgcaagaatttacgagtcgtcttgcccgatgccatgaatcacggtgaacgacaccaaatcgttagccagattccttcatttactttttggaacagtatccaaggtaatcttggcgaattcgagctaattgtgaattactaccgggagcgtaaactcattttgaatgagcagattggtgtcggcggttattcaatgggtggcatgacgaccggggctttattgacccatcatcctgaaattaaagcagccacaatcattatggggacccctaacctgaacgcgtacgcccaattagtccgcaaacatgcgcaggcccatgcttattacattcccagtgatttagccctattgaccagttggctagatcactatgatcttaacctgcaaccggaaaccatcaatcatcggccacttttattttggcatggtactgaggatgaacggattccttattcacagtctcgtaatttctttgaccgcgtgcataccgccccgtatgctgaacaagtggcatttatcacgggttatcaagccaaacatctggtcaaagtgcccctgatgaacaaagttgctaatttcttcgattattatttaaattaattatcaaaggcgcaaccatggttaacgttagccttaaaagagcgtgcttagtcggtcacccgattaaacacgctcttttaaggctactcaaactatctgtcacacattgtaatgatcgttattgtcagctacaaattgtctttctttaccaacaaaggtcgcctgcttattccgtccgtgctggccgaattcgtttgccccaatattggaaataatctgtccgtaacgcaccgttatagagtttccggcgtttcgtggctttttgtccatagaagtcttcaaattctaagtcactggtcaggatatacttgctccaacttggtaatttactgtaaacttggcccatttgccgatagagaatccggacggtatcccgatcgcttagccgctccccatatggtgggttggcaattaggaccccgttgatcttgtcagtcgtaaagtctttgacagccagttgtttgaaatgaatgtcatgcaacaacccggcttcccgcgcattcagcttggcaatgtcaatcattttaccgtcaatatcgtacccactaatatctagctcagtgtcgtaatcggctaaactatcagcttcgtctctcaattgttgactcaggccagccggaacccagtcccatttttcacacgcaaatgcgcggttgaaccccggggcaatgttgcgcgccagcaaagcggcttcgattggaatcgtccccgaaccacaaactggatcaacaaatggattatccggataccacttagctagcatcactaaggcagcggccatgttttcttttaagggtgcgccccccttttcgactcggtaaccccgtttgaataaactagagccagttgtatccagcgttaacaacacgtgatccttattgatcgccacttctaatgggaacaaagcgcctgtctccggaaggtgcccgctccgatgataagtatcggctaactgattaacgatcgcctttttgacgatagattgcacgtcgggaacactgtggagtttagagttgcgcgatttaccttcaactggaaattcagcgtccatcggcaataactggtcccatggcaatgcgagggtcttttcaaacaactcatcgaacgtataggcatcaaattcaccaacgatgatcttgattcgatcagccgttcgtaaccacaagttggtccgcaaaatatctttgatcgttccgttaaatcgaacccggccattttcagtttgaacttgataccctaaatctcgtaattcacgccccactaatgcttcaattccgctagcggcggtggcaattaatctaaattcttgcatagtttcctcctgcgacgcctgttctgcaggcgcatcttgttgagtaaatatttccactaaattggtttcctcacctagtttagcataagttgctagtttgctaactgatcgaataaaaaaactgggacaaaagcgaacttttgtcccagtctcctgtctaaatgtaaattcctgtaggccatgttttgtacctagttaaagtacagggtctgttaactaggcggtaatcatctatctcgagattactaatctccccccacatttagttcagttccttatgtgaagcgcccctaccgtagtttgggttgcccgctcgtggggtttaccgcgttccaactcaaccgtttccaattgagtatcgtcactgtggcacttttcaggaatactcgggcatagccgaagccttagccgtttttcccgccgttaccgataaatcggtaccccggcttattttttcaccgagcacgaacactacaagcatcgcagcttgtgcgagcatggaccttcctcagccgacataagccgaccgcgattacccagaatttacatcgaatcacaattatagacggtgtgattcattttgattattatctaattgggcgccaaagacatgacgttccaagttagacaaacgtttcagaatatccatattcgtcaccgtactagtcggttgtgaagatggactggttgcaccgacagcgacttgcttggtaagctcgtcaaccttggcccgtaaccgttcattttcatctgaaagttgttggttatctttagtaaatgactcatagtccttaatgacattatctaagaagccgtccacgtcggcgggatcataaccccgcatctttggcttaaactctttttgaaggatgtctttgggagtaaaattacgtttagccatatttaaaaacacctcattgttattcgcgcgacacccattaggcatccgcattacttaaaacattgtagcagactttattcaaaattaaaaccattattctgtttttctgcatattcgttggcactttcctgtaaccagtcgaagtcgatcaaggtcagcgggtatggatgggtgtcactaaaattccgaatcaaatcatagtcatacgtgggttttcccgggttatctggatcatacaccaacgtcgccgcatccgtatgggtaaccataaattcttggtaattttttaattgttgcggattttcatacggttgtttactgactggtgcatgaaaatcgacttgggccagcaaagtctgtaatttagcttggttattttcattccagcgcccaccaaattcaccatatggtaacatcattgccactttcaattctggatatgtctttttgagcgttaaccctacttccgctgtccactgttcaataccgagctgaccacccgttatcagccaatccataccatcctcgatctgcgtcgttaagtaattagttaacgcaaacttaataacttttagtttatcatcctgatcaccaaagacattcaactcgtaactccggtaaccactaagccacaaccggctcataaaagagtctcctttctgtcactaaatcggtccaaatcagttaaaaactcacagatatttcacattccctattagttaatggtaaaatataacattattaggaggttgattaatgtgacgattcgctatccaaacggtcaagtttatcgccaacccggcccaactaaatcgaaatcttccaaatttgctaacgtcaattttggcgatcgcggaatgagcttggaacaagaaatcaatgatagtaacgcctattatcttgaaaataatatcgcagttattcataaaaagccaacgcccattcaaatcgttaaagtcgattatcccaaacgaagcgctgctgtcattcgtgaggcttattttaaacaagcttctactactgactataacggtgtctatcaggggaagtatttagattttgaggccaaggaaaccaagaacaaaacagcctttccactaaaaaactttcatgagcatcaaattaagcacatgcgccagtgcttagctcaaagtggcatctgttttgttattattcggtttgcgagtttggggcgcctatttttgttaacagccagcgacttatttacttattgggatcatcaaggagatggtggtcgcaagtcaattccactgacggatattgaacatttagccgcagagctacattatcaaatcaatccacgcattccctatttggatgcgcttgatcatattattgatgagacctcatcaattcattaaaggagaacatcatggcaggtaacaatgaacagaactcacgggttgctcgcagaaaaagccaacctaaaccacctaagaaacactggtttcggcggattattttatccttagctgcactgtttgtcatcggggtactcgctggtctagcacttttcttctactatgcgcagacggcaccaacagtcaaacagagtgaccttgtcaatacggggaccgctaagatttacggcaaggatgacaactacttgacctcgttgggaaccaacgaccacgaatacgttaagtctagcaatattccatccacgcttaagaatgccgtcgtatcgatcgaagaccgccgtttttataagcataaaggggtcgattattaccggattcttggcgccgcagttggcaacttaaaaggtagctctctcgggatgcaaggtgggagtaccttgaccatgcaactcgttaaacttgcggtcttttcaaccagtacttcagaccgaaatttgaaagtcaaagcccaggaagcctggattgcgcttaatcttgaaaaacattatagtaaatctcaaattctagagttttacatcaataaagtctatatgggtaacgggatttatggtatggggactgccgctaagtattactacggcaagtcattaaaagatctgagtcttagtcaactcgcactgctcgcaggtatgccgcaatcaccaacctactacgacccgacgacttatccatcatacgcaactagccgccgtaatctggtgctggaagcgatgtacgataacaaggtcatctccaagagtcaggaaactgctgctgaaaaagtcagtgtcaagacgggcttaactagttcgggacgttcaagcctagcgaagcatgaaaagacgaataaaatcttggatgcttacctgaacgaagtccgtcaagacctcctcaaaaagggttataatttaaccgatggtgagaaagtttatacgaacattgacatggatgcccagaaacggctttatgacattgccaacacgtctcaatacgtcaactatcctaataatggcaaacagactttccaattaggggtatcggttgttgactcatacactggcaaggtctcagctatgattggtggtcggaaaaccggtaatgtcacgtacggaaccaaccgagctgtctggacatcacgctcaaacgcttcgacgatgaaaccaattctcgattatggaccagccattgaatatttgaattggccaacttacaagtcgttgtctgatacgaaatacaaatatcccgggactaacatttccgtgcatgactttgacaataattacttgggcaatatgacgatgcgtgaagcactggttcaatcacggaacatcccagcaattcgggccttacaagccgttggtaaaagccgagcccaaacctttgccaataaccttgggatgaacctcaaaaccgttaactatgccaacgggatcggtgctggtgtttccaccttacaagttgccggtgcctacgctgcgttcgccaacggtggtgtttatcataagccatactacatccgtaaagtgactacttctgatggcgttacgacatcgtatactagcactggtaagcgcgccatgaagaaatcaacggcatacatgattactgatatgctgaaaggggtcatcaatagttctactgggacggcgacaaccgctaagatcagcggcgtttaccaagctggtaagactggtactgacaactatgcttctcagtataaaaacaaagtaccatccgatgccgtcgttgactcatggatggccggttacacgaagaattattcggtcgccgtttggacgggttatgataaatccaccgaagctggtggttacctagatacctccaacgaaaagatctcacaacaaatttatcgtgccatgatgaattaccttcagcagtattcaccaaactctgattggaccaaaccaagctcagttggcacgactaaacggaacggtatcgaagagctttacgttgttggtcacctcttctccagcagcgaagcatcatccggaacgtctagttcagctagttccaattcagcaacaacgagtagttctagcagcagtacggtagcaagtagtgatcgttcggaaagtagcagtagcagttccgaagccgcttcttcctcaagcagtgccgaaagttcgtcgtctgaatctagttcggaaagtagtagcagttcggaagcaagttcaagctcggaagcaagttccgaagcaacttcatcggaaacaccgaccgctgatactaataacacgactgaaggacaataagcatcacccaagaccactgaattcgattcagtggtctttttagttgcattgttttactgaaataacacacaaaatttacataaactaaactcaaaatcaacgtcaaccggcgaattactactacaatacaaagtaacttaataaactgaacaaacttatcaagacaaaggagttacatatcgtggttgccattaagctacacgaattatccaaaagttttcaaggtccggtaatcaatcaactcagtctgacgattcctgatcaacaaatcacggcattaattggcccgtccggttccggcaaatcaacgctcttaaacatgattgcgggtctcacgacacctgacagtggtcaaatttcatttgataatcagcccatttttgacgccgcgactcattggaatcagccgcccgcccagcgtcacttggcaatggtttttcaagactttgccctgtggccgcacatgacggtccaggaaaacgtcgcctttgcattagaaaagcacctgaccaagccggaattggctgatcaagtcaattgggcgctggaacaagtgagcttgaccgacttccgacatcgttatccgcgtgaactttcgggtggtcagcagcaacgtgtcgcccttgcacgcgcactagcgacgcaaccagatttaatcttattcgatgaagcattaagcgcgcttgaccctgaactacgcacacggctccaattagagattcgtgccctaattcacgaccagcatctgacagcaatctttgtgacccatgatcgtccagaggccttgcaagtcgccgaccatctcgtattacttcaggatggcaacgtggcccaagcgggcacacccgcgcagctgtaccaacagcccaaatctcagttcgcagccaatttcatgggccaacttaatcagatcaacgcgcatcaggccattcgcccagaatatgtcacagtcagccaaacgaataccccgcagcccacttaccaaggcttggtacaacgttcaaccttcatgggtgaccattttgatacttgtgtccaagtcggcacctacgattggcatgtccagaccaagttgccgtacaccgcagcaccgattacattaagcatcgatccacatcaaatactaactttttaggagttgacacacatgtctaaaacggcaattatcacattatccacgctcggcgtgctcgcaattggcacgtcactttatgttaatcaacatcagaaaaaaacgttaaccgccaacgcgcaaactagtcaacaagtcttaacagtatacgccgccggacctaaacccctttctgatcaaatcatccacggctttgaagccaaaactggcattaaagtcaaaagttttgacggcacgactggtaagattttaagtaaggtcaaggccgagcaaggtaattcacaagctgatgtgctgattttggcttcaatggccgctggcgttgaccttcaaaagaacggtcagctattgacctatcagcccgctcgagctcaacatctaaatgcgcagtttaaggacgctagccaccaactgatcaattacagtgcttcggcagttggcatcacctacaatacgcagcacatcaaatcggcaccgacagactggtctgacttaacaacaaccccgtatcgcaatcaagtgaccatcccggaccctcaaacttctggttcaagtctggactttatcaatgcttatcaaatgaagcatggtaccaaactgctcaaagcgcttcaagaaaatggcgccgatatcgggggtgccaaacaaggaagtgctcgatgcggtcattaccggccaaaaagcggccgtcttcggtggggtcgattacatgagtctgacggctattaaaaagggcgagaagattggtttcgtctatcctaagagtgggaccttagttaatccacgaccagcgatgatcttgaaagctagtcgtcaccaagccgcggccaagcaatttattgactacctcttgtcagctaaagttcaaaaacagattcaaaaaagcaacttaattcccggtaccgcgagcgatttgaccgatccacgcaatggtgaaaccatcaaagcttacacggtcaattggaccagtgctaatgctgctctgactaaaaacgtggtcgcatttaatcaggtctttagccgatgagtaatcgccaagtttgcttgtccttatcaatcatcatcagttgcgtgttggcgattctaattatcggccccctcgtcgccctgattggccaaacactagttgggcaatcaccgctccaactatggacacagctgacgcattcaaccaaccgcgtaagcattcaacacagtctgttcctcggtggaggcacggtgattgggacgaccctactggccacccccttggcatggatcatgacgcgtactcgcttaacaaaacttccctggttgcattggctcttgttagtgccgttcatgacaccaccatatattaacgcgatgggctggttatatttcttccaaccacacggactactggcccagctcaatccgagttggcaccaccaatttcagtggctattttcgccattcgggatgattgttatcatgagtctgcacttataccccgtggcttacctaggcttgcgcacggccctcacgcaattcaaccagcgctggcttcaggcagctgaagttcacggggtcagcatttggcggcaactagcgcggatcacggtgccaatcatgttagtcccatacttagctgtgtggattctagtctttaccaaaaccttggctgagtttggtacgccagccacttttggccggagcattcacttcgaagtgctgacgactacgattcaaaaggacctcagtcagtggcccttagattttcaaaacggggtgctcactggcaccctcctactgacaattgctctgattgcctggggtgcccaacaatggctgctacgacggccggccgttaagttcaccgggcaacggtcagcgccacaatatcagcatcctggcgtgacggctttggcaagcactttcgtcactacggtcatcgggattgcgattatcctgccatacagtgccattgtgctccaatcgctgctcaaacaacgcagtcttggttggagtctgtccaatctgacacttgcacactatctggatctgctgcgctttgacagtccagcctggcaagccattatcacgaccgtgggattggccttattgatcagcagtctcaatgtgatcgttggtttattcttaagtgtcggaagtttaacgaaacactttcccaaatggctacgacgattgtgttatacattaggcgcattgccactcgcaattccgaacgtcgtcttagcattgagcttaatgatgctcttttcacaggtgctggcgttcactaaattatacggcaccctgaccatcatcctgattgcggatgtcaccttatttctacccactacggtgcaatacttaacgactgctctcaaggcgtttgactcggaattattagccagcgcgcgcatcttcgaaccaagcttcggtcgcattatcctaaagattacacttccgattctatggccagcgctactcaacagtttcgtgatggctttcattgccacaagtcgtgaattagtcgttgccctcttgttactgccttcggggatgacgaccgtttcaacctttatctatcaatcgtttgaacagggcgaagcagccgccggtatggccctagcagtggtgacagtcgtccttacattcatcgggctgattggcgctaatcggctgcactcagtagacaagcgcgtggtagcgtccgaaccagtgtccaaacgacaccaatcggcgcttgaaccgacagttgcgaacaacaaaggacaactttaagcaatcttcaacactaccagaaactaaaaagctggtcgcacgaacgtcaaaattgacgtcgtgtgaccggctttaatcatcacttacgaattatttagactcatcggccgaaacatcaccggtttgttcaaccgtttcagctttatcattcggcatgttaacgacggtgacgttagcttccgtattacgaacaacatacgctgtcgttgaacctaagaacaggcgggaaatcgcattggttcccgaacgaccaattacgattaaatcaatattttgggccttgggaacatcgaccgcaattgttaccttgggcactccggtttgctgaatcgtttcggcgtgcaactggtgggccgcaacttgatcctgggcccgctctaataacttcttactctgggcttgatcaaaactcatcatatctggtgccgcactcgtaaaaacatccggactgtagacgccaaatcgattaacatcgatgacgtgcaataaaaataactgggagtcaaaaaccttcgctaacgcaatcgcgtgttcaagtgcataataagcattatcggaaccatctaatgggactaggattcgtttatacatggttgagacctcctgataagtttaatgagttacaacatttattatcataatcataacttatccatgattgtcgagcacccaatatgcttattaattatcaaaataagatagcggtttattgacgttgatcttagtaccgtaatatttttgcttgatatacttttgaatatcagctcgatggtataatttaactagtttaaggtaacttgcacgatgcttgttcttagcggccgttgctaagatattgacgttatccttagtactcttattcagactttcgtggaaaatcgaatcccgtaaaacgtgtaagtgtccttccaaagcaaccgtattcgagattaaaaccgcatcgacacttttaatgatccggggaccggtcgtatcatcgatctgtttgaatttcagatgacggggattgcttgtaatatccttcactgaacctaagacatcaaaatttgccgccagtttgatcaggcccgctttttgaagcagcaacaggcctcgcgaagcttgagagggattgtcagcaattgcaatcgtagcgccatccggaatttcatcgacgctttgatattttttggagtagattcccattggttccaaataagtcgttcctaacgccgccaacttggccttgggattctgctgattatacgtttcataatatgaccaggactgaaaggcgtttacatcaacgttaccatccgccgtggccttgttcagctgaaccccatccataatctgtttgaccttaatcgttaggcccatcttcttggcatcctggctttgagcaatgtgctgccagacttcatagtccgaccccattgatccgaccgtaatcgtggcactctgttgcgcgcgggccgaataactcgttatttcatgtaaccccacacaaataccgacaattacggcaataccaatcaaccaccatgctaatcgtttcatcggcttattcccccttttttaatggtgtgagacgcttttgacgagccaatcaccaaatagctgtacagcaaatactaaggttaaaatgatgatcatcgccacaaacgtcacgtcgttttcaaatcgagcgtacccaatactgattgcaatgtcacctaagccgcccgcaccgatcgcaccggccatcgtcgtcagaccaatcaggctaatcaccgtcacgatggagacgcgaatcaaatcaggtagtccctctttcagataaacccgaaaaataattgccatgggactagatcccatggactgagcagcttcgacgatgccctgatcaacatcgagtaacgcattttgaacttgccgggcatagaaaggaaaaataccaaaaactagtgggactaacgatgccgtggtccccaccgttgttccaactaaatagctggtcaacggcgaaattacagccagtagaataataaatggcactgaacggagtaagttcgttaacttgtctaatatttgatacgaagggccatcagctaaaatgccttggggttgtgtcacaactaatagcacgcctaatcccaagcctaatattcctgcgaccagcgcggaaactgcggtcatatagagggtctccaacgttgcttgaataaactcagctttcatttgcaagacattcggaattaatgttgtcattagtccaccattcccttcacaacttcttcattaataatgcgcgtgtgtacgccttgagcggccatattagtgaccgccgtattgaaggccgttaaatcacccgtaataatcgcaatcatgtcaccaacgttttgaccatcgatctgatcaatattggcaaacaaaatgttaacgtcgactcccagtgtttgcgataactgcgagacgatcccctgcttcgtcgattgaccaacaaacttaaacgcaatcagctcctggtccgctgctaattcactcaatttaatcgttttagtgattcgttgaatggcggcccgaacattggtagacgtttccacaaaatcaaccgtcaggggtgctttaggggctgtgaagacttctgcaaccggtcctcgctcgacaattcgcccatcagccataacggcaacatggtgacaaatactcttgatgacttgcatttcatgcgtaatgaggacgatggtgatccctaactcgcgattgacccgttgcaacaactcaagaatcgctgccgtggtctttgggtccagcgcactagttgcttcatcagaaatcaagatttgcgggtcagtgaccagggcccgcgcgattgccacccgctgcttctgcccaccggataatttatctgggtaggtctgcgcatagtctgttaatccaacgagcttcagtagccgtaatgctttggcgcggcggtcctgtttactaattttttgacccagtaatgggtaaataacgttgcccagcactgtccgtgattgcatcaagttgaagtgttggaagatcatcccaacgtgtttccgggcttgccgtaatgcagctggcgatagcgtttgtaaggcctggccgttgacgactacctggcccgttgtcggtggctgtaagagattgatcacccgcaccagggtacttttgccggcgccggaatagccgataatgccataaatatcacccgtctggatttgtaaattgacatcttgaaccgcgtgaacgacttggtgcccgtcgtcaaaggtcaccgcgatgtcttttaaatcaataattgcctctgtcatagtcgacttcctcccattaaaaaacgcccatcgtctctaatctgattatcagattaaggacgaatggacgttttccgcgttaccaccttacttcaaatgaccctcacaggccaccgcacttcgagtaccgccactgcaatttctgggtgagactctaaccgcataacgggcgtaaccgtcaacacttaaccccatcagctcagcgttgaaacttgcattataagaccatcttcaccgttgtgaaatggctacctcgcaccaaccggcagttctctatggcattccaacaacggctactcatcttagacgtatttattaatatatttacttggttgtttacagtattacgctattttaatgagaagtcaacatttaattataaccattctctaatttaagcgatattcactgattccggtctgctgatgtgccccaccagtttatttgggccgacagattccggtggtctggtttcgaccccagtgcgctgcgccaacgacgtaaacagctaccattgatgtgaagcaacgcccaattcatcccgtaaaaaaagtggtaacgacacctcacccaggcaatcgtcaccactttatcaagattattgtaacccccgacatgcttttcagcacaatacttaagactggtcttcacctaatttgaataacggaatcttcggaccggcattttcacccgtctggcgttgtggttgcggagcggaattcaagcgttgctcaatactgcgttgccgctctgcttccacctgagcagccgtcttcaagttacgtttctgccagttcaacagaattcggtccatatacgtcaagttatagacttgacgcagaactgcttctcgcagtgccaattcgataacttccggttcataatggtcttcgtcgaaccacttactaatactttccatttcgattggtgacaagtcccggccaaattccgtttgaattgcccgaaaaactttttcccgccgattttcatttgtggcctgtccggaaacttgatcaccagccggttgtttcttgagtgcgacggccagcttgtcatacaggccgtcaaaattataacggtcatgaatcttgtggtcatccgccgtgatcgattcaatcgtcaataatttcttggctaacatttcatgtagccgctgaaaaacgacattcgtcgattcacctaaactcttggcaattaccgcagcatctggaaattgattaccctgatcgattaaccgtttgaactgcaaataaaccaataattcatcatttgtgaccccaatttcacgatagtgggccaataatgcgttcgcaatggtcgtttgaccatcattcactaacgcggcagctaaggactccatctcgttatcatcctttcactattaagagcgtgagactaggtcccacgctcttaataaaactaaccttcaattaaagtttacgggtaaatccggtttaataaccgtggaaacggaatcgtctcccgcacgtgatcttcagccgtaatccaagtcaagaagcgttcgagtccgagaccaaaaccagcatgaggaacactaccatacttacgtaaatctaagtaccaagcatagtcatctggatttaagccggcttgtttgatctggccaagcaagtaattgtaatcagttgcccgttcggagcccccaataatttcaccatagccttctggcgctaataagtccgcacagatgaccacgtcgtcccgagttggatgtggcttcatgtaaaatggcttgatggctttcgggtagttcaaaacgaagaccggttgatcgaagtgatcggccaagaaggtttcctctggcgaaccaaaatcaacaccccagtccacgtcgaaatcatttgccttcaatagctcaatggcttcatcgtaactgatacgtgggtaaggtaacttggtgtacttctttaacgtttcaacatcacgacctaaaatgtcgagtgcgtattgacaatgatcaatcacaccttgaacaagaaaggcgatgtaacgttcttgaacttccaaactttgttcttgatgcatgaaggccatttctggttcaatcatccagaattcaatcaaatgccgccgagtcttggacttttcagcccggaacgttgggccaaaggtaaagactttgccgtatgccaaggctccagcttcagcgtataactgaccgctctgtgataagtaagcatcccgatcaaagtattcagtatggaataattcagttgtcccttcaggtgcactcccagtcaaaattggtgagtccatcttaatgaaaccttcttgattgaagaattcataggttccacggatgacctcattacgaatgttcatgattgcccatggccgcttagaacgtaaccagagatgccgatgatcgagtaagaagtccaccccatgttccttaggcgtaattgggtattcttcactttcaccaacgactacaatgtcttcaacttcgatttcaaaaccgaactttgaacgactgtcttcatgaattacacccgtaatccacatgctggcttcttgcttaacttccttagcgagttcaaaaacttcttcgctaacttggctcttaacaacgacaccttggaagaaggcggagccgtcacgtaattgtaggaaggcaatcttaccacttgaacgtttattagtgagccaagccccaatcttaactttttcgtcgacatggtccttagcatcgataatgttgatctgttgcaccatttacttacatcctccaattactttgcttgttcagcaattttttctgtcataaatttttgtaaccgtcgatgggcctctcgcaaggaatcgatatcagttgcatagcttaaccgtaaacaaccgggcatgccgaacgcctctccaggcactaaaccgacatgggcttctaataacactgcggtcacaaaggccgtggcatcggcatagccggttaagcgcaaggcttccgtaatatctgggaacaagtaaaaggctcccgcgggtttgccagctggcatcttaaacccaggtaaacgctcgattagtgggtatagttcgtttagccgcgcttcaaagccctgacgcatcgtttcaacagatgattggtcaccactaaaagcttcgatcgcagcgtattgtgatacggcggctgggttgctggcagcatgacctaacacgacccccatcttcgccatgatggtttgtggcccggcagcatatccgatacgccaaccggtcatggaataggcttttgaaaccccattgatcaaaaccacgtgatccatattagcatcatctaattctaacacggatgtaaattcattaccgttatataataacttttcataaatttcatccgcaattaccaaaacgtcgtgttcaacggcccagttcacgattgccgtcaattctgcacggctgaagaccagaccagatggattctgtggcgaattcaagactagcgcctttgtcttaggcgtccgctgcgcttccaaatcagcagcggtaaaccgcaactgttcatcggtgctaacttcgactggcacaccaccagctaatttaacttgctccgagtaactgacccagtatgggactggtagtaacacttcatcgtcgggattcagaataacttggaataacgtaaacaacgccatttttgcgccatccgttacgacgatctgattaggatcaaaatggtagtgatggtcagcctcaatgcgctgactgatggcttgttttaaagctggtaatccagttgccggtgtgtagaaactcgcttgtccattttgaatactatcaatggctgcttgcttaatgttatctggggtctgaaaatccggttcaccgattcctaaattgataacgtcaacgccgtccgccatcatttgcttggcagtcgcactgattttcaatgtcgctgacggttgaacctgcattactttacgcgataattccatgtacatccgcactcctttgaccttaaatattaataattgatttcagctggtttccattagaatactgcaaaatttcataacataaattctttttctggttcaagtacgtaatttcccacacgaccgtcccatcatactttccaagcgttgctttaataaccttgctaggattgcgttttgaccagaccttttttaaggctttcgtacgtgaaatcccagcggactgtttgataacggtcgttttatgatgtttattcgcgttaattaacgcgtataccggaacatttttactcgacgttcccgtaacgacgtaataactactggtgccattatactgtgaaaaggccgtcgtggtctttagtttgcccttgctgacggccagactgtacgccgtcttctgggcttggtgcattggccgttgtgcggcccataacgtgccataaaccgccacgataatcgctaaaatgacgaccaggataatcataatgagtcgctcagggtgccttctacgttgaactcgcatatgctcttcctttcaaaaacagataaattaattatagcaaatttaactgattgcggaatggtttcttacttagttttgaaaaaactttgaagttcctgcgtaatcatcgtcaatgaaccggctacgggcggcaacgttttcggtaaggctttaagaatcgtctgcccgtatcgcttcgtcatcaaacggtcatcgaggatcaccgctgccccccggtcttcatccgtccgaatcaagcggccgacaccttggcgcaacttcaatgccgccttcggtaacgcttcgttataaaacggattgagttgtgcttgccttagttgttgatagcgggccttggttgtcgtctggtcgggtgattcaaacggtaattgcgtgacgatcaacaattccagctgctcttgaggcaagtcgataccttcccagaaactcccggcacccagcaggatagcattatccccctgcataaagcgacgtagcagtttttcgcgactaccattgacgccctgcgccaagatttcgcaatcacccggtagatccgtttgatgcagactgtaaaagacggcttcgatcatattcagtgaattgaacaagaccaacgtctgctttggcgctgccatcacgatgtcgtgaatcgcacgcgtcaagtatgccacgcgctgcttgccactgggtgcttccgctgcagtagcatccgtagcgacgaatagccgtgcctggtgttctaaatcaaacggtgttgataatcggtgatgcttagctgttgcttggtcaatatccaattgcgaataaacgtactgcgattttccagtggcaaatagcgtggcaccagttaatagtggcgcactgaagtacggatagagttgtgttttaaaatacccttgcgtatcgatcaagctacccgcgagcgtgagactgccgcgatcatgccattgattaaggctcacccagaagacccgttgttcccgcgaagctggcactaaccacgtttgtaataactcatagccctgacgaagatgttgaagacgattgtcaaagtcgtcgaggacgtgttgttcactaggcaagatttgcgattgatcatgttgatactgctcatttaattgttgaaactgtaaaaaacagttttcgatggccgtttgtaattgtttgatcagcggattgtgggccgcaaagaaatcagtcaactgatccgtggtgattcctaattcagcaggctgattgccgcccttttgtgctggtacaaacgttctggctagcgccgcctgcagttgttgcaggtgtaggtcagtatcattcaatgaattatctaataatttcagacgataatcggcctgtggttgttccgcgaacagtgcccgtaaatttagactatgttccgtgtcaatgcgactgatcaagctgtggcaggtcgccatgtagccattgaaatcaaaggtctgccgtgagtcacgaacgacgccatctgccagatgctgggcctcatcaagaaccagcagtggccgctcttgacggctacccagttgggccacgtggcgcatcaggtaggcatgattggtaatgataaaagtcgcttgcgcggtcaattgatcccgaaagcgtaagaaatcttccttaaaaaacgggtcatcagctttcaacgaggccacgccatgatgggcgatttcgctaaagtacggcgcttgatacgtgctcaagtgcaattcatccagatcaccagtcgttgtcatcgttaaccacactagcacgcgcaacttcaataattgcgtttgcttcgaatgttcatgcaacgccaagccacgggcaaaccggtttaaatcaacgtaatgctgattacccttaatcacaaccgccgtcacaggattaggcaacaactgattcaacaacgccacgccctgatcacgtaactgcgtttgtaagaccgtcgtcgccgtgctaacgaccacctgttgaccatcctgtgccaagtaggcgagtggcagcaaatacccgagtgttttacccgttccggtcggtgcttcaatcaacaatggtacttgttcagcagactgttttgagtagtgccgataaatctggttcatcatccgggcctgttgtggccgataagtcaagcgatcaccaaaaatatgctgcttttgtgctttcgtcaacggatagcgtgccgctttacgacccgcggcttgctgtggcaatcgctgtttacgcagagcgagcccgtttttgatcactaagtcagttggtaactgctgtggatgttgtttgccctgttgaaaggcgtatgcaaacaagtcggccgtttcacgtggtaactccggtgctaattgcaccatttgttgtaacgtgatcaatggtaagtgtgcgagccgctgttgtaacgtgataaacaagtgggccgtagcaattgcatcactatccgcagaatgtggatgattatgatcaatcgccagcaagtgactcaagtcccgtaaccgaaaactcgaagctgtcggtaacagaatttggctcagggatacagtatcaacggcctgaattggtagttccggataaccgacacgctgcaattccgaattaatgaacggcaggtcgaagttcacattgtgggcaacaaaaaccgtcccctgtaataagctgtagaccgtaccagccaaatcatcaaagggtggtgctttgcgtacccgtgcattactgattcccgttaaattctcgatgacggcgggaaccgttgttaacggattaacgtccgtggcaaatgtattaattattttattgttcttaacaaacgcgcaaccgatttgaataatccggtcgccgtccttcacactagttccagtagtttcaatatcaactaccgcataagttgtgtttggtttcatggtcatttccccaagttatggattgtaaagatgttcattagattggtaagcgtataaatccgttatcaacactaacgctgacgttcgaccaactaatcgatctttatggcatatcacgtgaagcgtatttggatggacggaagaatggtcaaagtggcgcaacacttggtcttgaccactagcgttaacgattccgtcagtcaggccaactttgcggggacaccccagcgaacggaacagttacgccgatccgccctatgtagctccagctgattcactcattcttcacaccgatcgttacttacacgtcacgtcgatcattgtaaattatagcatattcagtgcggggaactcagcccgaccaactcttaagccaaattcgctcggttaatggcgagtgaccgaggatgaattaactggccacgggttgactcatgcgagcaacgataacgttcatgaaatgtcgcgggaacgtgccagacgtgctacccggctagcgaacatgagcggttgactattcgacactcgcctaatccgaacatttgcgacacatgaacgctgggcccacgtgtcttaggggcattcagataaacttcttttgccatcaacagcgcccctatttctaatcattttataattttaacatagcggacggtccccgtctgcccctgataactagtttgccgtccgtttttcatcttaatgattgaatttaattgaattattactttccaaaccagtttaactaccatttcaactgaaatcagtcactccggcagggttagcatggcaaaagaagcgctaataaggtattatgaagctattattaatctacttacagaaaggcagcgacacgattgaaagatctagctaccggtactagtcatgccaaaattattttaattggcgagcatggtgtggtttacggacaacccgccattgccttgccgatttcgaccatccaaatgcaggccattattcaccgccgcgatgcagcgcagacggtcaaaagccgttactacaacggtgacttcaagatgatgtcagccaacttaggcggcattcaaacgctcattagaactttactcgcacgctttgatgcccccgagcagggcttcgatattcatatcacgagtgatattccatctgaacgcggaatgggctcctcagccgcagcggccgtggccgtaacgcgggctttttatgatttcttcgaccgaccactctcccaccaagaattattggccactgccaatgtagcggaaagctacacgcatggtcaacccagcggcttagacgttgcgacggccagcgccaaaagccccgtctggtttgttaaggggcgtgagaactttccgattccggtaaagcttcccggctatttagtcatcgcggacacgggtattaaaagccaaaccaaagttgcagtggcaactgtccgcaacttactaatggttgagggcgcgacgattcaagcacgcatcgatgacttaggccgtttgactcgtcagacccgaaccgcgcttgaagatggtgacatgggcggcctagccacggccctgaatggtgcgcaggatgacctacgttccatgggtgtcagccaccccgctctggaacaactactggcagtggcccgccaaaatggggcgctggctgccaagttgaccggtagcggtcagggcggttgcctgattgcgctcgcgccggaagctagcatcgccaaccaattgtcacaaaagttggctgcggcgggtgccactgcgacctgggtcgaaccactcttaaacgatgactaaatttaactttggaggaaaaaacatggtgaaaaccgttacggccaaggcccatactaacattgcgttagttaaatactggggtaaaaaagatgctaccctgatgctcccacaaaatgggagtatttcgctgacccttgatcacttctatacccagaccagtgtgaccttcgatgagcatctcgatactgaccaaatttactttaatcatcagcatctacccgcaggcaaatctgcacgaatcagccagttcctcgacctgattcgccagcgcagtggtcaaaccaactatgccacggtcaaaaccgaaaatcatgtgccgacctcagctggcttagcctcgtccgcctccggatttgcggccttagcaggggctgctagtcgtgcggctggcttacaactagatgcggctgatctatcacgactagcacgccgtggttcaggctctgcgacccgctcaatttttggtggttttgtcgaatggcatgccggccatgatgatcagagttcttacgcggaagtcttacaagacccggtcgattgggacattcaaatgatcaccgttgttttgaaggctaccaaaaagccaatcagctcaacggacggcatggcacgggtcgtcgcgacatcaccttactatcccgcttggatttccacggctgagacggacttgaagcggatgcgccaagccatcgctgaccgtgacctcacaaccgttggccaaatcgccgaaacgaacgcaatgcggatgcacgcgctcaatttgagcgctgagcccgcctttaactacttcaccgcggatacactgaccgccattcaagcagttaacgacttgcgttcacacgggataaactgttattatactttggacgccggcccgaacgtcaaaattatttgtgcgggtcaagataccgacatcattatgaccgggttacaacaacactttgacgctgatcaattaatcgtcgccaaacctggcccgggtatcacgataacagaaaaataattcagtttaatttaaaatgatcagtgatggtcatgaaaggatatgatggcatgataacggtgaaagcccctggaaaactctacattgccggtgaatacgccgtagtggaaagtggttatccagcaattattgttgcactagatcaatttgtgacggcaacgatttcacctagcgaaacgattgggagtatcgtttctgagcagtatcaagaaaactcaatcgtctggcgacgtcagggagacgcgatggtttttgataatcgtgacaatcccttccattatattttggcagcaattaatctcactgaaagctatgcccatgaattggggcgtgaactcggtgtttatcatctcggtatcaatagcgaactcgatagtgctgatggcaaaaaatacggtctcggctcttcggcagcggtgaccgtggcaactgtcaaagcactatgtcagttctaccatttaccgatggataaaaataaacttttcaaattagccgcgattgcccatctgtccgtgcaaggcaacggttcgcttggtgacattgctgccagtgtctatggtggctggatcgcctaccattcattcgatcggcaatggttacacctacaacaagctcagtcaagcttgagtgatttgttgacgatgccgtggcccgatttaaagatcgagttattgacacccccagccgccttacgtttgatgattggctggacggggtcaccggcctccacatcacacttagtcgataaagtggccttagtcaaggcgaagcaacgcagcgaataccagacctttctaaaatccagcaaagcttgtctaaaacgtatgatcactggttttcatcacggtgacttgcacgtgattcaaaccgagttgcgaaccaatcgtcaactacttcagaaattgggcgatttcagtcacgtgacgattgaaacacccctgctgcaacggatgattcaactcgccgaaagtgctggcgcggccgcaaagacttcgggcgctggtggtggtgactgtgggatcgttttgattgatcaaaccatcgacccacgaccattattagctgcgtgggctcacgatggtatcgaacaacttaacttaaacgtgcatacggttcaggataccgttttaccaaattcttaagcagtttattgacgagcctggcagccttgctggactcgttttcagattctaaattaattggaggtggcaccgtgccacaaagtcaacaatctcatcggaaagatgaacatgtttcgttagctgaaaagtattttcatggcgaacaagccaatgcctttgaccaggtccggattcgccacgacgcgttgccggaaactgccgtggccgacgtcgatttagccaccaccgttggccagtggcattgggacagccccctctacattgaagcgatgactgggggctcacagcgaacgggcgaaatcaacgcgcgtttagggcacatcgctgcagcttgtggcttaccgattgcgaccggctctcaaagtgttgccatcaaagatccccaagtggcccctacttttgccacgatgcgtgaccacaatccgaacgggctgatctttggcaacctcggtgctggccacccattgtccgcggcccaaacagcgattgcaatgcttaaagccgatgccctcgagctccatctcaatgtcgttcaagaaatcgtcatgccagaaggtgaccgtgactttcattggctcgccaacatttcggatttagtccaagccttaacggtaccagtaatcgtcaaggaagtgggttttggtatttcccgccccacgatgcaacagctctacgctgccggcgtacgctacctagatttaggcgggcacggtgggactaactttgtcgacattgagaatcgccgacgtgctaaccgcgatatggcctaccttcacgactttggcctcaccacggttgagtccttgctaggcgttcagaaccgaccggatgatctcacggtcttagctgctggtggcgttcgacagcccctcgacatcttaaaagcgttgatgttaggcgctgacgcggtcggcatggctggcaccgtgctacacgccttactccatcatacggacgacgaagtcattacgatgctgacggattggcagtcgcaattaaaacgcctatttgcactcgtcggcgtaacgcgtgttgatcaattcaaaagcagccgtattcaggacaaaatcttgctatcgtctgaacttgttaactacaagcaatccatcaccgattaaaataaagcgcggtatcacaagcactggaatgtcattccatacttgtgataccgcgtttttgttataaccaagaataataaaaaacaatgtttccctatggaaagcactgctttataatactgacaaacaaaaatccctcatcaattatttggaaacatatcgataccgattcacgtacgtccgtggctgaccagcccgtagaacaacatccccaaagccatgatgattaatagcatccggcaaaatttgcagttccacggccagcgcatggtagtctcctagccgatacggctgcgttcgttcgggattagcggtaaagataactaaaccattgcgatccgtgttaatgagcagtcgcccgtgagtcgttgccaatacaccggcaggttcatcctggtggtcaagcacatagcaatcatcatactccgtcttgccagtctcttggatcaaccgatcgagctgcgattgaatcgttggctgctcgcgaaagtcatacgctggtgacggaacgtagaagacgcccgtggggaccttctcgtggtccgtgtgaaccagtttggtcgagttgatacgtaattgctgggaattgatcagtgcggcctgaccatcaagattaaagtaaacgtgacaggtcggattgaataacgtatcagcagtggtcaccccgtgatagctgatttgaacctcatcatcggccgttaacgtatagcttatagttactgtcaagtcgcctggaaacccatcgtcagcgctcgctagcgttgtcgtcaatgtgacagtgtcgccatcaggatcaaaacgagctcgaaaattatgcgtttgtaagccatgattgccaccgtgtagcaaatgccggccgttatttggcggtaagcgatacgtctgcccattcaaggaaaacgtcgcgttaccgattcggccagcaactcgacccactgttttgccgacttgataaggcgtctcgatataatccgccaagttatcaaagtgaagcactaatgattgtggctggcggtcgacctgcacttcgaagtcataccacgttgccgcataactcaacacttttagtttgctatgatggatattttcaatcgtgtataaatagactggttcgtcctgatacacgccaaatggtactgcagaaatcgtacgcctcattcccttcgatcagtgcaaattgaactagtcctgtgtcaatgtttgcgtggtaccatccacttgaacatcaattggttctccggcgatcagcttcaacgtcgtcccattgtgatcaaccgtaacttcaataatccgatcacggaagacctgacggaatgaatacttcgtccattgttttggcaagaatggccggtaactaagttggccatcatgaacacgcatgccagcaaatccttggaccatcgcaatccaaccaccagtcattgaggtgatatgaagaccatcgaccgtatcattgttgtaattgtcaagatcgaggcgtgccgtccggttatagaaagctacggccttgtcttcatagtgcaggtcagcagctaacacggcgtgaatggctggtgacaagcttgattcgtgaacggtcattggttcgtagaaatcaaagttgtgctttaattgatcttttgagaaatcatcaataaagtcatacatcacttgtaacacatcgccctgcttgatataaggtgaccgtaaaatgtggtcccaagaccaatgctgattgattggtaattgatcagccggaatcgcggaaacgggtgctaggtccttatccaggtacccatcatgttgaacaaagatatccaaatccttgtcatatggtaagtacatccgatcaacgatatcttgccagtgggcacgttcttcagccgtcacatttaaggcagcagcttggtcatcactgacctgatctaagatttcaagcgtgtatttcaacgtccactgtgccaaataattggtgttaaagttattatcaacgttgttctcatattcatctggaccagtaaccccatggatcatgtactgctgattgcgcttgctaaagtgtacccggtctgcccagaaacgagaaatctcggtcaacactttactaccttcgtgtaagacgtatgatgtatcgccggtataacgcgtgtagttataaatagcaaaggcaatgtcgccgttacgatgaatttcttcaaaggtgatttcccattcgttgtggcattcgatcccgttgaaggtcaccatcgggaacaatgcaccatcaagcccctgttgacgcgcgttgtgataggcaccatccaactgcttgtaacgatacatcagcaggttgcgggtaacttctggtttggtaatgcccagatagactggaacggcaaatgcttccgtgtcccaataagtcgcaccaccatacttttcaccagtaaagcccttgggtccaatattcaaccgtggatcatcaccataataagtgctaaagagttcaaataagttgaagcgcatgccttgttgagcctcagtatcgccttcaatttgaatatctgattgttgccagcgatcggcccagccggcttcatgggctgccaataaatcatcaaaggattgggcgctgaccgtatctgtcaaacgttgaagtgcggtcatgatggcatcatcagtcggatagtcccgcgacgtaaccacaacgactcgcttttcaaagctaacgctggcaccagcttctaacgtaccgtagtaacgatcgattgtggccgtgtccgtcacttgagccgctttgtgatttagttttgtcacataactaacttgcatcccagaagtaaactgtggggttccaaaatcattcggcacggtctgagcaatgagccgatcgtcgctaacttcgtgaacgttccagaaatgttcatcatagttggcatcttcgtttttaacgtcagcatccagtgcggaagccacttttaattcaaccgtttggtcgcttaagttttcgaacgtgaccttttgaaccgaaagttctttttgggcgacgcttaggaaacgctcaaaggtcacgcgaacccgttgaccgtcctgatcaacgataaaggatcgcgtcaaagtcccgtgttgcatatccagatcaagcttaaaatcgctgaagttggccgttgctaagtcgattttggttccattgagtttaaaattgattttgatgaaattgacggcgttgataaccttgccaaagtattctggatagccattcttccaccagccaacccgggtcttgtctggataccagacaccgccaagataaataccgggaagcgtatccccagtataatcttcttcaaagaagccgcgcatgcccatgtaaccatttcctagactagtcattgattcttgcagccgtttgttttctggtttgaaatcagtcgtcaagacatgccatggattaacatcaaaaattcgtttcataagttaattcctcctagtttttgtacgtttctttgatcaaaccaactgtgcccgcacctactgcaaggacgatcccagcaaagatgaacatgttggcttgtgaattgccaaataatggatataatgcaaagctcaataaggacgcaacaatttgtggcaggcagattgagccgttaaagagacccaagtaagtccccatgtgttcgccagataaggcgttggttaccatcgtcaatggatacgtattcattgcggcccaggccatcccaaccagaataaatgagacgacaagtgctgattgactgtgaatgaagaaaattgagaagaagccaattgcaccaagtaataaactcaaagcataaccaagtttatgccgattattcggaaccttggctaaaacatatgaccaaacaaccgcggcaacggactgaacagcagataggatcccgtaccagttaccagcagcttggtaccctgcagaactggcattagtcgtgtgccaaacgttggcagccatggcaccggttgagtaggtccataagtattggaatgccatccagcagaaaaattgaactaaggccactaaccagaagacctttggcgctttcttcaagagtgccaaccagttaccaccagatttattagcgctttcatcaatgccgtgatacttcgcgtaagtgaccggatcatattcccgcacccgggcaatcgtgataatcgttgaaacaactaagattgctgcaccaatatagaatgaccagattactgaattaggaatgacccctttgctagccgtattagcgaccccaaacaaggtcaacaggaatgggaagattgccgcaatgacggcaccggtattcaacaagaagctttgaatcccgtaggcgtaactcttttggtcatcgttgaccatatccccgaccatcatcttgaagggttgcattgccacgttagacgacagatcaagaaatgccacggtaattgccccgaaaactaaggccgccatggaagcgtaaccaaatccaaacgagccagagttgggtagtagtaacatcacgatagctgcaacgaccgtccccagaatcaggtaaggtaaccgtcgcccacctaagcgtggggcccatgtccggtcagataaactcccaatgattggttgcacgatcaaaccagcaagtggtggtaagatgaaaaaccaaccaaggttatttggatccgcacctaaagtttgaaagatccggctcatctgtgagctctgaagtgtaaatgccatttgaacaccgagaaaacccagactcatcatccaaatcttattagatgacagtttcggtaacccggccgttgttttagatgtttctttcacaataaagcctcccaaaaataatatcaatcgcttgagtacaagttagattataaaaccgcttccaaatttatgcaagcgtttgcgttaaattgcatgaagacgctttatttatttatatcagcgcccgttgcgcgtgaaatccgctaataccaagggcttaaataggttctcacaggccataattcatataaagttcatataaaattcacaaaaaaatcattatattgcgtggtgttgcatagctaaatagcttcagttaataaagcgttgcatactgttgcatgagcaaatcacttcaatcggcgaatatcattttgtaaataactcattgctttcaatgattggcttcaaggcagcattattttacattatctgccatcaattattcatgtttagaacacgccaccctgctttaagattgaatatcgaggcaaaaaaatcgtgtgctcatgccgacttagcatgaacacacgattccaaattattcagttattaatccgcattggcaatctttgcaaaaccatcttgtaaatccgtattttgtgaactagtgaagttaaacgtcgtggcatccgcactgtcctgcgagaccagaacgtctggcgagccgttatggaaaacgtacagatacgtaatcacgccactagacgcgttgggatcagtagcagcagcaacgacctggtacttcacatcggtatcagcagtcgttgtccacttgagcttgaccgcgtcaccattgaccgtgattttatcttgatactgattattcttgatgtctgccggtaaactcaactcaccaaccgtgaccgactgaccatcatacgtcccctcgtacgattggttcatcgtatcttcccacgacgacatgaatgaggccaactcactcgacttggttgtcgaccacagtgccgcctgagttgccgtgctagcagacgacgcggacgatgatgacgcggcttccgtcgaatcagcggtttgtgacgaagacttggcagtcgtcgcggtcgtcgtcgaattattctgttgctggtgttccagccagtaatagccaccaccgaatgcaacgactaatacgacaatcaagatcaaccacggcgcctttgatgctgaatgcggttgttcattttgacgcgcatgttgcgctgaacgagtagctggttgcgtcgtagtcggtgcggccgaagctgacgcgctggcggctggtgtttctgaagcagccgttgacgacgtggattgcgcggcagaactcacagcggccgtcgatgttggttgcgccgaactagctggaataatcagccgtgcaccacagttttcacaaaatagcgcgtcaatatcattctttttcccacaatttgggcagtacataactcttcctccaattatcatgattgcttgggttcgtttgttggtcagcttgaatgcatcgttcccctattttaacatggttcaaataatccatgacgactactactcatttacgacgccgcactaacagcgaacgggcgttatgccttaatcactatcatgtcaggttagagcgttgcgttttctggggtcgccaagaaccgtaaacccttagggaagaagtttttgaccgtcttcgcgacgacctttccgaacccaactgggagcccctcacaagttaagacccgaaaaccagtggcagtcgcacttgccagttcaaaggtctccccatgaacgtacacggcccactgctcacgcgttatttcaattttaggtaacgacagatcatcgctggctagggctaacgcgtaacttggttcaaagcgtttcttcttaaacgtgcccaataaaattccgggacgaaggaccttaagtttgcgcgtaaccggcatcatcgctggcacaccatataactgatcgccatgtgcttgtaggacgagtcccggcaaactgtccgttgcttgcttttgtaaaaagtccgtccatagttgccgttgtgtggcacttaattgttcacgcaccacttttttgtctttgaccacgccggtaccgtgatagaccagcttggcaataaagtggccctccccacgcatcaaatgtggaaatagacgcgccgccttggccagattgggattgccatccgcccactccggcttcgcatcgaccatcccagccgtcttgaccagtggttccagttcaaactcaggataagtcttaagtaaccacgccatcatttgctcgtcttcttccggcgcaaaagtacaggtcgaatagatcaaatgaccgcccggacgcagcatcttgaccgcttccgttaaaatctctcgttggcgtgcggcacacgccgctggatagtcgggcgtccaatactgaacggcgtcatgatccttacgaaacatgccttcacccgaacacggcgcatccaccaagatccggtcaaaaaagcccggcaattccttggcgagggcggcgggtgtatcgttggtgataaccgtattacgagccccgtagcgttccacattatcgccgagagcggtcacccgttgccggttgatctcgttagtcaccaacaagccggtctgatgtaggtagctcaacagatgagtcgtcttaccacccggtgccgcacataggtctaacacccgttcaccgggctctggttttgcaaattcaccaacagtcatggcacttggttcttggctgtagacggcacccgctaagtgttcaagcgcattgccgtttaccttaccataatacccaattgggctgtacggcacgggagcgcccattttagcacgcatcgcagccgttacagtcttattcggattgacccgaaatcccttttcgactgaaccatcaaacgctgccaaaaaagcgggcgcctgatcgcctagtagttgttgatatttttgaataaattctgcaggtaattgcacccaaatttcctcctcgactaaaaagtatcctcaattagattaccacattttgctccgactgtaaggtagcaaagattcgcaattaggtcggatttatgctaaattaaattaattaactgccggaaatatgggagatgtttgttgaatatggaaagaaaactaattgcgttagacttagacgggactactttgaatgctgaatccaaactcaattcagcgacgatccaaacgatgcaacggttacaagcagcggggcatattgtgagcataattaccggtcgctcctaccagggctcacaagcgatctatgaccagttacatctcaagagtccgatgatcaactttaacggctccttgggccatttaccccaccagacgtgggcctcagaataccaattcacgatcaacaaagcgatcgtcttggcgctcgttaaatatcgcgaacaattgggtatcaatgaaataattgccgaaaataaaaatagcacgatgacagcgggtcaagatttgattgcaggtcaattcttcccagaaattgccgacagcccccgacttacaccggagacgttaactcggaatcctaattccatcgtcttgctcgtccagcttgatcggcgtgcggccatcattgactggatcacggaacgctttggtgaccaagtcgacgttggcgtttggggcggcccgaatgctatccttgagattacctcgaagggtgtccacaaagctaagggtgtcgcctatctagccgattattttcagatcccacagcgcaacatcattgcctttggtgacgaacataatgacctcgaaatgttggcatacgctggtcttggcgtggcaatggccaatggtaccgacaagatcaaagcgacggctgacgatgtgaccgcctataataatgatcaaaacggtgtggctcgttacttgaacgactatttcgcgattgcggaataagtccggatacaccgcgacagtgagacgctaacgatctgatgcttccgagccgtcactggctatactttaaagcactgactgcgcaccatcatcgattaacggacgcgatacccgcttttaatcaccaattaaatacggcacttccagaatcaagacccatctggaagtgccatatttagctattttcaactatttggtttggcgttaatgggttcagacgtccgcaccaacgcagcggaccaaaatcagtcacgctcttcgacggtcgcatcggccacctttgaagcggatgcgcctgcagtaccactctcagactgccgtttttccgccaaatacgaatgacgcatgccatagctaaagtagatcactaagccaacgatgaaccacacgcccgcgtataatttcgcctggatatccaagcccatgaagacgaacagcgcacctaaaaaggcaacagctggtaacactggatagaacggcatcttaaaggccggtaccgcgatatcgacgccttcacgccgccgcaaagcatagatgcccagcgagacaaacatgaaagcaatcagggtccccgcggaaatcaattgtgccagaaacgcaaacgggcaaaacgccccaataatgatcgcgacgatcgtcaagacgagtagcgcgttgttaggctgattatgatgtaacttaccaagccacttaggtaacatcccatcacgtccaaaggaataaatcaaccgtgagcccgctaaagtcatcccaatcaatgccgtgaacatccctagtacagcaatagcctgaataacactagcaacgatcgggtgaccggcttgccgtaatgcccagccaactggttcagcgttattggcatatgatgaatatttgaacataccgactaagactaaagcaaccgccacaaagagcaccaccgcaatgaccagtgaacccagaattcctcggggcatcgtcttgccaggattctttgcttccgctgaattagcggcgatcgaatcaaagccaatataagctagaaaaatcatcgataccccggcataaatcccttgccaaccgccaaatgcactaccatcagcgttcaaatgatacttaggaatgaatgggacatagttttgtacatggatcgccgtcgcaccgaccacgataaacgtgagcacggctaacactttcaacacgactaacacattttcgactcgggaggctttactaatcccacgtgagagtaataacgagaccagcgcaatcaccaagacggcaatcaggtcgaccacgccaccatcagtcccgaacgtattcgacaacgctttcggcagcgttagtcctaatggtgacaaaagtccccgcaaattggcggacaaccctgaaccgacaaacgccagtgcgataaagtactcggcaagcaacgcccaacccgcaatccaaccaaagaactcgccaaacatcacgttgatccacgaataagcggagccggcaaacggcatcgccgccgccatttcagcataagcaaatgcaaccaggccggcaacgatggccgcgacgatgaacgaaaagaccactgcggggcccgcgtggttcgcggccaccacccctggtaatgtaaatatggacgttgaaacaatcgtccccacgcctaaggccaagaagtccttgaccgttaatacccgcgctaagtgggaatccttatcttcataaatgctcggatcttcctttaaagttaatcgttttaataaccgttgcattaaaatcctcctcgttttaccaaccaatcttaccttgaggccgtttgaccagcccctgttctgcggcagtcagtgcttcatctaacacggctaatgcggtatctaactgtgatttggtaattactaatggtggttggaaccgtaaaatatttcctttgagcgtaatcatgaccacgccccgttcaaaagcagcgtatatgacgtcactggcaaactccggatcaggttgcttactctgttggtccttcaccagttcaatgccgccgttcagcccgtacatccgcacctgcccgattttaggatggcgctgctgaagcgctaagaactgttccttagcgtaacgaccatagttgctggaacgggtaaccaactgttcatcttccaaaacgtcgattgtcgccaacgccgccgcacagcaaaccggattcgctgcggtcgtgaagacgtgcgccggcgctgccagactctccatcacttcacggcgcccaatcaccgcactcaacggtaaccccgaagccagtgatttgccaacggacatcaagtccggtcggatgccgggaaagttttgaatgctccacatcttcccggttcgtcccatcccttgattgacctcatcgacggcaaataggataccgtgctggtgacaaaaatcataaactaattgaacatattctgctggcgctttccggattccgccgtcgccttgaatcggttcaataatgacacacgccgtttcttccgccggtaaataggaatcaaacggcgctttgaacgcttcaaagtaccgtaatgcgagttcatgttccgtctcatgcggcaaggtacggtaacagtcaggatacggcacgtgcacgatgccaggtagtaacggtcccatcttacggaccatgttcaggctaactcctgagagtgacattgagccgtacgttgacccatgataagcatccgtataggcgactatgtattgtcggtcagtataagcccgcgcaaatttgatgatggcatcattagcatccgaaccagaattgccaaatgcgacttcattgtcggtacccggagctgattttgccagccgctcagccaattgttgttctggctgatgatgaaaatatgcaggcgtgtaatgaatcaacttggccgcctgttcctgaatggctttaaccacgtgggggtgcgtgtgacccacgttaatggccgaagcacttgccaacaaatcgatgtactgattcccatcgacgtcggtaagcagggccccatgcgcatgatcaataaccaaatcatagtagttgattcgtgcagccgtcgccatatactggtcctcacgttcaatgagttgctgatctaaacgatggttttgactaatcattcgcatacctccattaatttaataagacttattttaatcattctttaatttatatgcaagtctttttgcccgcatagtcggttataaatacccacttttaccggcatagggctggttttaacgccaattatatttttaattaataagagataaattaacaaaatcaatcaccgtctcatacaactaattaccaacaacagatcaaaaaactggcatcattttaaatgacgctcccaccgtgaacagcatcgttcaatgccccatatcgacacaaaaaaaacgattatcacccgccccttcaagggtcagacaacaatcgttttgtttagttggcctcacttatttaagtatgcggctaggccccaacagactagccctaagacggtcgttactgctagtaaacacaaactttcttgattgacttccggtacggaccaacgacggtaagtttgcatcatcgtcggcaccgtggcggcccgcactaattggtatccggtcagccaacccgttagactcgcaatgatcgtcaccaacacgtggcaacgcgttaacggtctgagactgtcgtacttagcttgtaactggtagcgtgctttcatcgaaaaatcacttcctcgcgaattcgcgacctcacgacaatttgaataacttgaatataacacgccggtaccgcgctcccaactgttaagcgccattcacaaagtatctttacagtaactaatcttgcagtaagtcgctttcatcacccccgctttacatggtgaacgtaatcgtcgtcccccgggtcatcacgggctgttggggtgctgacaacatccccgattggccggctttgagcttctgagtcgctaaacgcgcaacagccgcatactgggtcgttgtgattggtgctgaacagattcgctttgttcgtgactgctcaaattgataccactgtgcggcacgtaatggcactggatgccgctgtaaatcccccacgtgaattttaaacgttgactgacgggtcacaattggggcgagcagccagacccaccgggttattgcttgtcccatcctaccaccaccgtttcgcatttgttaccgttattatagcatagcaaaacggaccgctgcggcctaaaaagagcaccacaacggtccggaaattcaatgttttttattgcccgatttttctaaacgcttgacttgattttgtaaatggtcgaccttagtcgtcagcgtatcgattttagtcagcaattgtcgcaagtcgtcatcatgttgtggttcatcgatcgttacattctgattcgcttgcgtggtaaagaagtcagtaatcgtacttgttaacaaaccaataaaaccgatcccaccgaacatcagcccgaccgcaatgactttgccaacggcggtatggggcgtgtcgtcaccataacccacggtcgtcgccgtcgtgatggcccaccacagtgaatctgataggctttgatgctcaaaaacagaaaagagcaacgcactgagtacgataattgcaatactgatcgagaacaggtaaataaacccagtactataaataaagcggtgaaaatcgtgcgtccacttaccatccagtccaagcttccaaaacaagtggtggtattggatcatccgtgccaagcgtcccagccgaaagagtgcaaacaccgggtgcatgggaataatccccatcaaatcgaacgccgaatgaatgagaaaggtcttccgatctcgagaacgaatcaggcgcacaaagtagtccaccgcaaacacgactaataagccgttactgatgcggttttcaacgtgccaatcaccgatatgaaacgataataggatcacgttaactgccgaccagagtgtcaaaagtgtgacaattaagtgatacaccgcaattcttcgctgctgtcgctgttctgcttccatcctgcttacccctattttataaactggtaataatatagtccacttttataaaaataaccacgataagtgctaaaaatttagtgagctttaccaattcgttacaaccaagttcccaaaacgaataacactgggtagaggatgaagaacagtgacgcacttttgaccgtcgtaatgaacgtcttctttttatcttgcacatcaaagaacggccgcataccttgccacatgattggcagcaggaggacgacccaaatcgtaacgattggtgccagtcccaacaagacgttcacaagtggccaaatcccaccgataatcaagaacgcctgaatcagacggaccgaccccggcttcccaagatagtaggccaaggtgtagcgatgattcagaatatcttcatcacggtccgccgtattattcgccagctggagacaaaagaaaatcagcgtcagtggtaagcatagtaagaaagtcgtcccaacgatcgaccaggtcaacggatgctgtccatacgtcgatacgaccacacaagtcaattcgattaaaaaagcaattgctaacgccacgaccgtctcacacagcggggtcgcgttgattggataaggaccagccgtgtaaaaaataccaatcacatagccaaccagccccaggacgagtactagccacccggtccgcatgacaagccaaataccgggaatcagtgagatcaggtacagtcccaatgctaggcgcccgacacccgcgacgggtaactgcaagcggccgattggattcgtcttctgtgcatagccttcccgatcacgggcatggcgataatcataatagttatcagagacgttgacggctaaatcaaaaataaacacgctaaccaaacacaaggccacgttaagccagttgaccgtacccaggtgatactgtgcaatggcactgccgagcacaaaccacataatattaagtggtgccgtataaatttctgtcagttcatagaatactggccaagttagccattttttgaacattttaacaactcccccaccggttatttaaatcgttaattttctattgggaccttattgaccatcgtcaccgtcgaagactttaactatcaaattttaacaaaccacacgcctaacgcaagcaaagcggatagatttaacaaaaaaattaggcctcacatgcacataagccgctgaaagcacccattttgctttcattcaaccgcatcacttgcaggtgagtttctaaacaacgggcggacgccggggcaatcattccagttttactgaaaccttccatacgatcagcagtccgtaactaatccacttatattgcccattttagcactgatcccagccgagtgttgcccaagccgctcgacaataaccgttacatacgtaccgcgaacttcgtcgaatttaaaaaagcatttcaagagccggactcctgaaatgctaatcgatcacgcacgctacttggttttttccggcactgataacgggagatctaagcgcgtcaagtcggcgtaactttcacgttgcaccacgagttggctatgcccctgttcacaaaagacaacggcaggtcgcggattacgattataattgctagccattgaatagccgtatgcgccggtatctaaaacggccaagacgtcacccgctttggtggccggcaactgttgattccaaatcaacatatcgcctgattcacagtacttaccagcaatcgaggcaacctgttcagctggcagggtcggatccttggctaagactgcttcatacttcgcttggtatagtgctggacggatattgtcacccatcccgccatcgaccgacagatacttcctaatgcctgggatatccttctcatcgccaatcgtgtacagggtcgtcccagcagctgcgactaacgagcgtcccggttcaatccagatttctaacatgggaacttggtgggccgcagtttgagcaagggtctccttaacaatcgcatcgacaaaatccgttggctgtagcggatgatcctcggcagtgtacttcacaccaaagccacccccgacattcatgatttgggggtaaaaattaagttcccgttgccagcgggcaaactcactcacgagtttgtcgacaatcatctcaaaaccgttcagttcaaagatctgtgatccaatatgacaatggatcccaactagcttcaaatagggagcggcttgcgcagctctgatagcctggtccgcttggccgctgttcagatcaaaaccaaacttggaatcggcctgaccagttgaaatatagtcatgcgtatgcgctgaaattccgggggcgattcgcaacataatcgtcgttaactgttgccgctgtgccgtcaacgtcgtcagttggcttagttcatcgaaattgtcgaccacgatggttccgaccccggcatccaaggccatggtcaactcagccagcgacttattattaccgtgaaacgaaacggcagccattggaaagtctgcttgttgggcggtatacagttcaccaccggaaaccacatcacagtggatgtgttcttgggcaatcaattgatacatcgcgaccgttgcaaacgccttactggcataactgatttgatagttaacgtggttttcttcaaacacctgcttgaacgccgcgatctcggcacgaatcgcaccggtatcataaacatatagcggcgtctgatacgtcttggcaagggtcaatgtatcgacgccccccaccatcaaatggtgcgccgaatttaatgcatccgtctttatttgttcgttcacagtctaacctaccttctcaactttaaaaaaagccggccacgtcaaattcgactggtccggcaatgaacaacctattctgcttcttcgtcgctctttaagacaccaccaacactgtagcgatttttctgcatttcacttaaaatcacgtgaatgtgttcggctggtgcaccggtattcttgctgaccgcgtcagtcacgtctttcaccaagtttttaagttgttcttgtgaacgaccagcaatgagatcaatgtgtacgattggcatgaggccacgctcctattcttaattcactatttttgaatgttttaatcttactttaatcttttccattttgcaagccacgacattgctaacttaatagtacgttgcccatagctggcagtttgacggcaatgattcacttggcgtagtcgtgcaaactgaaaatccccattcacgagcaaacatgctaaaattaatttaacaaaaatgattatgccacgatacggcactcaattatgtcgcgtggagaaagaaggctccaaatgttgacccaccaatttaacccctattccgcctgcactagtatcttagtgggtaagaacgccagtgcagatggttcgaccatgattggccgtaatgaagattcacgcgccgcttgggcgaaaaagatggtcatccacacgcaccgtgaattcgatgaaccacaaactttcaaatctcaggatcaaagccacccctttacgatgaccttgccaaagattcgtgccaaatacacggccacccctgaatggacagccgaatacggcctatttgaagaggatggtattaacgaatacggcgtagcgatgagtgccaccgagagtgcgtactgtaacacccgcgtgctagctgccgacccctatgtcaaagatggtatcggcgaagaagccatggtgacggtcaccttaccatacattcattctgctcgcgaaggtgttgaacgtctcggacacattattgaagaacacggcacttatgagactaacgggattcttttcagtgatgtcaatgaagtttggtacatggaaactggtgctggtcattactgggtcgcacaacgcatcccagacgatgcctacgcagtggttgctaaccagctggcaatccaagaaatcgactttagtgaccatgataattatctttatgctaaaaacattcgtaattttgtcttagacaatcagttagcttccatggataatggcttgaatttccgagaagtcttcggtacggccgacctttctgatcgatattacaatacgccgcgtgtttggtatggacaaaagtgctttacaccaagtgtgagccagacccccgagtcgtttgacttaccattcattcagcgagcggatggcttaattcacatcgaccaagtcgaagcttacttagcatctcattatcaaggcacgccgtttgaccccgtcggccaggggaccactacggagaaacatcagtaccggccaatcagtctggcgaagacgcaagaatcacacgtcttacaattgcggccggactttcccgtcacgctgagcgggattcactggttggcgatgggcgtagccgctgaaagtgtctacgttccgttctatgccggtgctacgaccactccagcagcttatcaagttgcgactgaaaaatacgatgcggcttcggcatactggattttcaagcacgtcggtatcctagtcgacgcccactaccatgaactacacggggaattacaaacagtacaaaaggaattggcgattcaacttggtcaccacattattgtcacggatcagcaagtcgccgctttgactggcgacgaacttgcgacggcactgaccacggctaatcaaaaagccgctgaccaggccttgagcgcaatgcaagttctcgccgctgacctgattaccaaaagcaccgatatgtcaccgttgaattacgatactgatttaaacctataaatcacaccccctatccgtttttgggggcaaccattattgatgtgatgcggctttcggactggtcaaaatgcgcttagttccgttactatccaaataaaacttggtgcacgccgttaacctggcaatggtgtattttttcttagaaaccatcagcatgattatttctaagggaggttaccattgatgaccacgttaaagtatctacgccatagtatcctaattgcgtgttttttaaacttgatttttgccctgactcattgggccggcattgccagcaaccatctgttgatcgctacaaattacgggctcagcgccctgattattttaatggttttgttgaatacgatcgttttgacacatcatccgacaatcatgctcccccagcgacaacaaatttggctgatcaactttgctgccctactgattgcctttctgaccgagtggttatgagcattgtgcatattggttgcgttttgtcatcacttatcgcaaactaaggttaattcttatattaggaggcgctttttatgagtgatgttaacaagaagttcgatagcaagaaggaccagttgagcggcaaggccaaagaagttgaaggtaaagtaaccggggaccgtgcacgtgaagcccagggcaaaacgcaatccttaatgggcaaagctaaggacaaattagctgacgcagaagaaactgttaagggcgtcgtggatgaagctaaggacaaaatgaagaagaaatctgatgattaaaacttgtcgtgggcacggcgcaaacggatggtgatcaaaatcaccatccgttttttatgattacgccacttcaaatgagagcccccatcggcgcacacaaaaacaacttcgagtaagctagtacctcgaagtcacctgtggggctgtttagggtgatgtttaacattttttgatgccgagcgtaacagccaggctgtcaattggcactgttcaattgtgttttgaccgtcgaacccgtgcccactgaaccacgaacatcattatcaggacaacggcaattgcaccgattgcggctggtatcacagtcattccggctaactcaggccccatcggccccagcacaccttcaccaatgagcgccccaagaacgccagcaataatgtgaccgatccacccccgcgattgactggggctcatgatagcacctgcaaaagcaccaaccgccgcgccaacaatcattacccataaccaatgcatgctgtcatcccctttttagcggcggtgtttgaactgccgcacttctcgaaacacagtcaatcctaattgcccaattgcaatcaatagtgacaatttaccccaaaaaccaggggtctgtcgtttaattttagccattacggacacctccatcttttgataacgctaacaagtgctacttcaacaaatccttttatgcctaatcacaattactgcggctgaagcgcctgggcagcaacggttccgatcacaataagtatcatcgccccgctcacgactggcaacaacgtcattccagcaactattggcccgaaccatccaaaagacagctggccaccaagtgcaccgaataagcctgcgattaaattaattgtcgtttgacgccgaccatgtgcgcctaccgcatttgcaacgatacctattgttagtcctaatatcgcaacacctatccatcccattgtgaacacgctccatcccgatattgtgtgattaaaattatcataactataatatttatattgagcaatcaaaatgctcattgacccgactaattcagtaatgatgcatatcatttccagtcaaactagtgttcaagctatactgagactatcaaaagcttactaaataagcgatgaataaacttaattttttaatcaagaggtgattgtcatggcaacaacttacggcattttctataacggacaagcgggtaatgggcaagcggcaaccgtcgcccatcaaaccgcgcaagcgctatcgaaccacggcattgagtctcaattactgacaacaccaggaatcccccgggcaattgcgctaattaagcaaacgtttcctcaactgtcagcactaattgttattggtggagatggcacactgaacgttgcaatgacagccctaatccaagctgaagcacatattcgtatcggcgttattcccatgggaacggttaataattttgccacccgctaccaattaccaactgacccccaagcggccatcgaactaatttgtactcagccggcgacccaagcagtcggcatgctagtttgtaatcaacgccgggcagtcgtgagttcactgacattcggtaatttggctgacatttccaatgaagttcgacaatctgagaagcagcgattcggtaaattaagttatctttaccgtgctatttgccatattggtcacaataagtcactgccaattcgatatcaattcaaacacgaaggaagccacaccttaaaaacatggttctgtttgattacaacgaccaaatcagtcggtgggcacgtctatagcgcgtctgctccaggaaaaatgcatattaatctacttaacaacattggctggcggcaagtaattccatatatttggttcgcactaacggggaacttgcaaaactccaaggccattacacagctaacggcaaccagtgcacgaattacgagtgcaactggtcaagccgtgacgacacgtattgacggcgacccagcggttaaactgccaattgaattgacctatttgacagaccgcttcgaattgatcgtaccaacagtcatcgaataacgacgtattttttattaatataatcaacatattgattgcttactattaactttttgattatagttaaacatagttattaattaatcccaattaacacagggaaaaaataataatgttcacatcataactttattggggggattacgatggcatctgcttatcgcaaattttgggacaatcttttaaacttttcgggtacagcaacacgctctgagtactggtggcccgttatcattaactacattcttggtggtattatcattgcaattattcagatgattatgggacaccccatcgaggatatttacaattggagcgatctgagtgttaatacgatgagtaaactcatcgcattaatcgtttggttaggaacgctctcgttgaagtttcggcgattgcatgacagtgatcacactgcatggtggattttaattgacttagttccaataattgggaccatttggttcttcatcttaatggtgttgccgtcacgctcaaatcgttggcaataatttaactaggcgcaacttttattggctaagcggcccataatggttgcgccttttgtgactaagcgctggcagttaatcatattaatagacgcactaattatgtgaatgttatcattagtataataaatagcatcatttcatttaggaggtcctgaggatgtatcaaaatattctagtcccgcttgatggctctgataatgcctacatggctttaaaatatgcggtcaaactagcccagacgtttaaatctaaattatttctggtcaatgttattgatattacacgactgaatgcgtatagtcctgcagcttacgggggaacgctatatacaaaccttctaaaagtcgcaaaagataatagtcaggacattctggatcgtggtcagcaaatggcttcggcagcacaagtcgaatccctaccaattcaagttaatagttcaccaaaagctagcattgcaactgatattcccaaaaaatatgcaattgatctaatcgtcatgggcaaatccggcaccaacgcggtttctcgaattttgctaggctcaacaaccgcgtacgtcgtacaaaaagcggaagtcaacgtgacagtcattaacaaaattgacgaccctgattagacgactaatagaaggaaggaaaaatcaatgatcaaagaacgccctaaattcaattggcttcatctgctcattttcattgtggtcgtcgaagcaatcggtagtctgtcggcatggctcgcgggagacattaaggccgtttacaatgggctcaacttgccagtactatcaccaccagatggcctctttggcatcgtttggccgatcctatatgcgctgattgcgattgctggttacttagttttccagcaggctatgacacaccgtgaccgcctcatggacgccaccctgtttggtatccagctgttactaaactttatttggagcatcatctttttcagccagtcggcttattggtggggcttagtcattatcattgtgcttgatttagtcgtcttactttgcatattacagttctatcgcagtagtcggctagccgcaattttgatggtcccctacttggtctggatctgttttgcaacttatttgacattaggcgtcgcattattaaattaaatataatcacaattcaaataacgatcccatcagtcattgttactgatgggaccgttatcttattgtattaaagttttaacacggcttaactggtgttgtcaccgccaggccccgtgttaccaatcaactatttaaagcgttctacgttgtcgttttcttgaacgatacggcacagcgtaatcttgtggcgcatcttccggactggcactcgtccaatggccactaccctttttagctgggcgggcatcatctttgagacacgtaaaccgtgagccgtgtttatcctggataataaaaattcgactaaattcgttgatggtatcgactaccgtacaatccgtatgcttgatgttgaacacatccgtataaactttactcattattgtccaccccctaggaattagtatttaacattgttaatataccgcgtcttgaatgacaaatccataaatatacatctgctggttattattactaaaaaatgataatcgtacaggtcactgataccccgatataccacctaattcgtttaaattttcgcccgcaccaatcggccttgataaatgagtaattaatcagatacagttgcataattgatacctgttttcattgtaaaatcctggtctcgtacgatataatcagaatattctttttgtaaaattattacagtaagatggtgacgactagtcgcttcaatgctttggcggctttatcggcatcaccgagtaggttatcagtccgcaagcacgaacaacagggggagtattcaatgaaagtcattaatgtcgcactacacgtcaagcctgagttaaccactcagtatgaagcctttattcatgagctagtggtcaattcatcacaagaacccggtaacagtttctacggccacttcaaacaactaggtcatgaccatgactacgagattattgagcactggcaagaccaagccgccgtggatttccataataaaacaccgcacttccagaactttctcgctcatatcaatgagtatctaataactgagcctgaaattacccggatggatcactaacgacttggtactgtagtcacatgagcgcaactgacagtcacctattgaatcacaaatttgagccaccttggttcaactaacttgcattgaggggatgctcctgcgcgtactccttaatgctaaaatgccagctgccaagctgtaatcgcaaatctgattcccggcatccgcttaattattaccactaatttacaatagcaacctgttcttcactaatcagtaaagaccggtcatcgccattcgcttctatgaatccttaaagcacatttaaaaaggtcttactagccaataaacgccagtaagacctttacgatatctccaagacaacttttataatctaaaatcacctccaagtaaatttaggcctcatctaattactgtacgtcaatatctgagacttgatagaacgcattaccagtatccgctatattccaaacactgagtaacacttgatagcctttttcattagcagaaatattgacttgatgggttacaaattcactagggatggcaccattgtcattataactagctatcttcttgaaatcactaaacttaagtggtgcgtttggattccagccaggcttggtaatatagtaatcccaagtactagttttatgacgagcagttaactgccaagtcacactaagattgccggccttcacaggtgtcttataccaccgtttggcattttgctcgtccaatggtgcaaagttagcaataccggcactggcaattttgccatcaataaatgtattttggggcgcttcaatactctgtggttcatacataaccgaaccaatattggtattcaaaggcccacctggataccaagtactccccagataagctctgccacccgggtttgtcacaaagccatgtgctgaaacttgaatcacgccacaacctaaaaacgcgatcatcataccaactataataaataagtaccgtaatacatgattcttcttggtgctcaacataagatcccctaatattttgactttcttgcaactcgtatttacatacaaatatttcaatcgcaacacggaccgtctccgataaccaataccgttttcgactaatcacagtatcgacaaatctaaaaatcaatgatgttttcaagtatcaaaaagaccacccagttaaaaaactaggtggttttcttcgtattaattggtttagttaaccaaatagctattatgtggcacccttttgataatgcttcggtgtgaccccaccgccagctaatgaaaatttgacggtttgtgcgacattcttagcaatgcccaaagcctgaatctcttcaagggaggccccggcaatcttgctcatcgagccgaacttacgcaacaacttattacgcgtcttcggcccaacaccgggaatctcatccaggcgcgaactcaatgaatgtttggtatggacttgtcggtggaacgtaatggcaaagcggtgcacttcatcttgaatccgttgtaataaataaaatccttgactcttcggatctagatgcaaatgctgatcacctgcagaagcgagtaagtccgccgtcttatgatggtcgtttttgaccatcgccgcgaccggcgttgcaatccctaattcgttctctaaaacgtccttagcggcttccagctgaatttcgccaccatccatcaaaatcagatcaggcaacgccgcatgctccttcagtagccgtgtataacgccgtcgaatcacttcacgagtcgatgcggcttcatccgcatgatcgaccgtccgcaacttatatttccgatacaattttttattcggctgcccgtccgtgaaaacgaccatggcggaaaccaagtcggccccctgaatatgcgagtggtcaaaagcttctatcttatgaccagcgggaatgcctaaagcatccgtgatttcttgcatcgctcccgtcgtcttgcgttcatccaactctaatagccggaacttctcctccaagacgatgcgggcatttttttgggccatgtccagcaaatcctttttctggccgcgttggggcgtccttactgggatcccgagaatgtcacttagaacctgcttatcaaggccgttggggactaaaacttcacgtggtaaaacgttgtttttgcgattataaaattgcaagatgaagctcgtcatttcttcaggtgcagttgacactactgggaacaaacgtttctcgcgcttcatcaaccgtgcttgccgaataaagaagacttggattgaaagccagcctttatcgagatagaaattaaacaggtcgcggggcgtattatcgtttgaaataattttctgcttttcaactgtcatttcaatataattcagttgatcacgtagttcagccgctcgttcaaattctaagtcagcggccgcctgatccattcgtttagttaactgcttcttgaccgtttcaacgtgaccattcaaaaaggacttgatccgcttgatttgcgcgtcatattctgccaccggcaccgttttgaagcaagctcccaagcattggcccatatggtaatagagacacggccgcttctggaaaccatgacaacgccgcagcggatagaccttctggataaaattgaccgtttcctgagccgcgtaaacgttgggatacggaccaaaatagtagccaccgtctttacgaacatcactgacgatcagaatctgggggtcccgttcattggtaatcttaatatacggataaccggtccccttttttaatttaatattaaagtacggctgatgcttttgaattaacgtaatttctaacagaaaggcttccttatccgtcgaagtcacaataaactcaaagtccgcaatctcagataccaaccgcgcggtcttaccagtatggctacttttaaaatatgagcgcacccgatttttcaagttcttggccttacccacataaatgatctgactatttaggttcttcatcagataacaccctggtaagtccggtaacaaggataatttatgttcaatatgcgcggatgccataatacaccttcccttcgcttagattagcattaatagtataccgcccgccagcacggcactcaaccaaacagcccggaaatatgatttttattatgatccgaccattcgtcactgtcactaccgatcacagtgttacaaaaaaccggtaatcagcagctaagctgagtaccggttacgtgtggtttacatcaaaattttagaaagaaaatcttgggcccgttctgtttgcgggttcgcaaagaactcctcgggcgtattattctcttgaatatagccatcagccatgaaccagattcggtctgccactgacttagcaaaacccatttcgtgagtgaccacgaccatggtcatcccatccttggccaattcttgcataacgttcaacacttctccaaccatttcaggatcaagtgccgacgttggttcatcaaacagcatcacttcagggttcatcgccaatgcgcgggcaatcgccacccgttgtgcctggccacctgagagactacttggaaaggcatccgcgtgatcgtccaacccaacgcgttgcaataattcatgcgcctgcttagtggccgctgcgtcatcgacgtgcttgaccttcatcggcgccagtttaatgttttccaagacagtcatattgggaaataggttaaacccttggaaaaccattcccattttttcacgaagcgcgttaacgctcttggtatccaacgtcgtgagatcttgaccttcgaaagcgacttgaccacttgtcggcgtctccagtaggtttaagcaccgtaaaaaggtactcttcccaccaccagagggaccaatcaccacgatcacctgaccgggttcaactttttctgtaatatccttcaagacgtcgttttcaccaaagctcttcgcaaggtctttaacttcaatcactggtttagtcatgttgcattctcctttcgaagtagttcaggatccgtgaagcggtaaaggttaagatgaagtatagcaccatgataacaacgatcggtgcaaccccccggtacgtatctgaacgaacaatgttactttgataaattaattcagtgaccccgataatcgaaacaatcgagctatccttgatcaacgtaataaattcattaccaagtgatggccaaatattcttcaaggcttgtggtaagaccacgtaacgcatcgtttcaccgttggacattcctaaactacgagcagcttccgtctgcccaacatcgacggaattaatcccgccacgaatatattcagcaacgtacgcaccagagttcaaggaaatcgcaataatcccagaagtcagtgctggtaaattgacgaataacccaagtccgaagtacacaaacatcacttggaccatcattggggtcccacgaataaattcaacgtacgcggtcgctaaccaccgaatggcagtcttaagcggattacccttagccatccgtgctaatgccaataaaataccgatgataaaaccgaagaaaacggagcaaaccgtaatgattaacgtatattcgatcccggtggcgaacgccttccagtaatgccccattgacgtattaacggtattggtcttcaaatacttgccggcagccggtaagtattgcttcttaacgaggttctgcttcttgatccgatcaacggtcttgttgactttgttaacgagactagttgaccctttccgaaatgcgatcgccgagctcgttgcactagagctcatgttgaagtcactaggaatagcgaccaaactcttattgttggcaacataggcttccgcagaaggcttttccatcgccaccccatcaactttgtgactctgaagtgccaaaatcagatcagattgtgaagtcatccctttagccttggcagtcgtttggtttttgacggcattatattgagtcgtcccagtttgggcacccaacgtgccattcttgaacgaattcttattcttgtacttagccttatcagtcttattgatgacaatatcgtagccaccctgataataaacatgggtaaaatcaacatttttccgccgtgaaggggtcgggttcatcccagaaataatcatatcgatcttgccagtttggagggccaccaacagtgagtcaaatgacatggatttgatcttcaacttcacgcctaggtccttggcaacctgtttcccgatctgaacatccatcccaacgatcttgctcttaccgttgaccgtggcttgaaactcatacggtggataatcaggcgacgtccccatgactaagacgccctttttctgaatttgttctaatgaattatcggccgcttgcgcatgttgcgtctgtccgagtgggacgacggtcatgatcagggccacaataatggctaaaaaccacccaaatctttttttcataggtattctccttgttttgtaatttacaagaataaagtataaccgcatatgattatttatgcaagtatttttgaagatttctttattttatgcacaacaagggcgtttatacacggacaagccctaattttatgcataaatgacgaataactgacaaattgtcagaaatttgctatgataggcggtaatcgaaaggaatgattttatgagtttaaaagtacagcgtcaagataaccttgataagctattcgacaagtttgccattggtcctgacgataaggataaactcaccactaaagcagttcaggataccattgacgaacatgccaagcgccaagaaaataaggtagctgataaaaaggacgcccataaatagcagtcaaaaaaacgcgatggcagttagccatcgcgttttgatttgaattactatgttagcaaattttagtcccgatcgtttgcatcttttcacgccgctctgcttccgtttctggtgaaacatcgcgccagtcaacgaccgccaaagccccgtcgagcatcccgctatcatccttgagcgctaaagcattatgccagcgagaaatgttgaggccgttccccaagtaagcttcatcagccggggcaacgtgcatcacataaccagcattattttctaatggcgtggtatagtcgggatcggcgtctttaagaattactaactgaaacttattaccaatggcacagctgccgcccaaactcgaatatttattagaaccatcatcagttgttaagattacttggcttcctgctggaatcttatccgcaaggtaggcttgagcatcgtctttgatattaatcttcatagttaagcatcctttcgttttcaagagaattaagttgtgcacaactcttttacaatctttaatttacgctatttcaactgcaaatgcaattaatttacctagaaaaggacaaaatgacagaaatcaataatgacacggttataaaaattgagacctcgtcctgaaaactcgcggctcacgcagtcgttcgtcacaaaaaaagagtcgacgccccgcatgacctgttggcaggtcaactttcctggttcgtccactcttgactgactatttaactggtttgccattcggatacttatcgttgagtttaacaatattttgctgtgccacttcttcgaacggaatatccgcccattcggcaacttgtgataagtaccataacacatcgcccatctgtttcgtcagctggtctttattcaagctttcaccgtgaaacgtatactttttgactaagtccacgacttgaccagtctctgaagctaagcctagcgacaaattcgtcagcacctgctcatttccatatagcgtccgatttgctaacgactgatactcattaaattccaagttagttgcctcctaccgtgtgcgcttcgatccattgccaaacggcatccttgccttctttggtcttagctgaaaacgcaataaaatcgtcatcagcttggaagttaagcgtctttttgattaaactctcctgtttgttccacttaccgcgcggaatcttatcactcttcgtagccacgaccagcaatggcatctcataatagcgcatccactcgtacatcgcgacgtcgtccttagttggggcatggcgcgcatccaccagaataaccacgccacgcagcgtctctcggcttgtcagatacgtctcaatcatttgaccccacttctcgcgttccttcttagataccttggcataaccgtatcctggaacatcgacaaagtataattgatcttcaactttataaaagttcaatgtttgggtcttccccggttgactagacgtccgcgcatagctatttcggttaatcaacacattaatcagggacgattttccgacattggagcgccccgctaacccaatttctggaaacccagtagtcgggtactggcttggcgccaccgcgctcatgacaagttcaacgttatgcacttccatcgaattaactccttctgcaatcgtattgcattcattctaccatagtttttatggcggattcgcttccacgctcaaattcaatttaaacagcactcaggaccgcgaatgataactcatcgcggtcctgagtaactgtctattaattggctgaacgaaatattaggaagctttttgatcagccaaaactagttctggttcggcgtgatcagcaaccgtttcacgagtaataatcacttttttaacatcttcacgactcggaatgtcatacataatatcccgcatcgtgtcttcgataatcgaacgcaacccccgggcaccagtgttacgtgccaaggcttcctgtgcgatcgcacgtaaagcgtcatcgttaaagtctaattccgcaccgtctaacgcgattaaccgttgatattgcttaacgagcgcattcttcggttccgttaagatccggaccaagtcatcctcagttaaacgttctagtgcagtcaggattggaagacggccgataaattcaggaatcaaaccaaattgtaagaggtcttcagggacaacctgttgcatgaggctcttagaatcatctaagacggcattcttaccatcagtgtctgtaccgaagccaatcgtcttatcgcctaagcgacgtttaacgatgtcttcgattccatcaaaagccccaccaacaatgaataaaatgttggtcgtatcaatttgaatgaactcttgttggggatgcttacgaccgccctgcggtggcacgttcgcaatcgttccttccaaaatcttcaagagggcttgttgaaccccttcgccggaaacatctcgtgtgattgaaacattttcgctcttcttggcgatcttatcgatttcatcgatataaataatccctttttcagcacgttcaacgtcgtaatctgcattttgcagtaacttcagtaaaatgttttcaacatcttcaccaacatagccggcttcggtcaaagtcgtcgcatctgcaatggcaaatggcacatccagaatgcgagctaaactctgagctaagaaggtcttcccagaaccggttggcccaactaagctaatattacttttttgtaattcggggccatcttcggtctcttcatcattatcagccatggctttaactcgcttgtagtggttataaaccgcaactgatagggtccgcttagcttcattttggccgatcacgtattggtctaactcgtctacaatttcctttggcgttgggatatctgtcaattcatgggtttgttcttcgctaaactcttcatcgataatttctttacataaatcgatacattcattacagatataaacgccggggccagccacgatctttttaacttgatcttgtgatttaccacaaaatgagcaattcacagggccgtttgtctcggtattttcaaacattcattctcacctcatcgatgtatttacatggattaatcataacagaaaaactaagctaaaaccagcttaggcactgtcttctacgtccactactataacatggacgaacctaaacccgaaattatttgttcaatcagttggctaaccactttgaaaaccgaatgattatcacagaaagtcgccattatcagcgaaatagcaatcaaattaatattatgattagctgatgctatgtaaaagggtcttggaagcattaatcttccaagacccccaatttgtatctaattagtccttgtcgctgtcatcttttttgtcttccgctttagcattttgcttagcagagttggcaatcaaatcaacggcttggcggattgcaatgtcgtgtgacaacatgtcatcagttaaagcaccacgaacggcactttcttccatgttgtattgactagctaaatccttaacttccgcagcaatttcatccttagatggtttgatgttttcagcttcaacgaccgcttctaagaccaagttagtcttgacccggcgttctgcatcagcagcaaattgcttgtgtaagtcatcttcagtagtaccagtcaacttgtagtaagtctttggatcgataccttgttgttgcatgttagccaaatactgatccatttgacgatgaatgtcgtcttccttcatggcatcaggaattgcttggatttcagcattgtcaacggcttggtttaaagcttcgtcttcaatagcatcatgtgcagcggattctttttgttccttaagttcgtccttgatcttagcttttaattcttcaagtgtgtcaacgtcttcgtcaacatccttggcaaattcatcatctaattcagggagttccttagtcttgacttcatgaaccgtcactttaaaagtggcttctttgtcttgtaagtcttcggcttggtagtccttagggaaggttaccttaacttcagtttcgtcgccagccttgacaccaactaattggtcttcgaagccagggatgaatgagttagaacctaattcaagtgaatagttttcagattcgccaccttcaaatggttcgccatcaacgaatcctttgaagtcgataacgacagtatcgcctttagcggctggttggtcttccttcagaactaattcagcttgtttttcacgccgtgattctaattcggcgtcaacgtccttagcataaacccgtgtgttttgacgcgttacactaagttctttgtattggccaagcgtaacttctggtttaaccgttacaacggcctttaatacccaaggcttacctttttccatgctgtcaacatcgatttgaggttgatcaactggttcgatttcagtttccttgattgcttcttcatatgcctctgggagcacgatgtttaaagcatcttgataaagtgcttcttcaccgtacatttgattgaagatttgacgtggaaccttacccttacggaaaccaggaacgtttaagttctttttagtccgttggaaggccttgtcgataccttcgctaattttatcagcaccaatttcgaatgttaattcgccttggttgccttctttcttttcccactttgcagccattgtattccctccgaaacattataatttctacaattctagtcaattgcatacttgttaagtttaacctatcgacaccgtaaagtaaaccgaattggccaaaaaagcgcgtaagctcgcgatttattgtatatttttcttaaaaaaagcgacctggaagaagacttccaagtcgcttagatcaatcaatgaaaatcagttagagattagtcatcaatttctgaaacaacaccggcaccgacagtatgaccaccttcacgaaccgtgaacttggtacccttttcgatggcagctggttgaatcaattcaacagtgaacgttacgttgtcaccaggcataaccatttcaacgccgtctggcaattcaataacaccagtgatatcagtggtgtggaagtagaattgtggacgatagtttgagaagaatggcgtatgacggccaccttcttctttgctcaagatataaacttcacccttgaacttcttgtgggtttggatcgaacctggcttagccaaaacttggccacgaacaacttgttcacggttaacaccacgtaataacgcaccaacgttatccccggcttcacctaagtcaagcgtcttacggaacatttcaagacccgtaacagttgacttaagaacatcttcgtgtaaaccaacgatttcaacttcgtcgccgaccttaacagtcccacgatcgatacgaccagaagcaacagtcccacgaccagtgattgagaagacgtcttcaacaggcatcaagaaaggcttttcagtatcacgaactggagttgggatgtattcatcaacaacatccattaagtgcatgataaccttttcttgttctgggtcgccttcaagtgctttaagcgctgaaccacggataacaggaatatcgtcaccaggaaaatcgtattctgaaagtaattcacgtacttccatttcaaccaagtcaactaattcgtcatcgtcaacaagatcggtcttgtttaagaagacaacgatatagtcaacaccaacttggcgagccaagaggatgtgttcacgcgtttgtggcataggaccatcagttgcggcaacaactaagatcgcaccgtccatttgagcggcaccagtgatcatgttcttaacgtagtcagcatgtcctggggcatcgatatgagcgtaatgacgcttttcagtttcgtattcaacgtgggcagtgttgatagtaataccacgttcacgttcttccggagcagcatcgatagaagcaaagtcttgttctttagccaagcccttagatgctaataccttagtgattgcagcggtcaaagtagtcttcccatggtcaacgtggccaatagtaccaatgtttacatggggttttgttctttcataatgttcttttgccattaatgaaacctcctgtgattttcgcaagaatagtgccgaggccaaaatggtctcaacaattctttagttagtattatactacatcctagtgaaaaggccaaatcgcgcacccatcactgagaatccttaaatattatatatagcctaatctgatttgtaaacagatattattcaaaaaattgaatttttgttagtaaattcttattacgcacgcttatgattgtaaatcaaggctaaattgctgaattttttgttgtactttcatcattttttcagtttgatcattgggctccgttagcgggtcccccgtttgctgactgatcaaaatattgatccaagccgtggcatcagtaataacctgtgcggcgcgaggatataaatacattaattgcaattgtaaaagttctcgtaagctttcatatagaaaaacatctcggtcaccaagccgcgcttccaaaacacggtaaacggccttgctcgtttcatcttgaccgagcgccactaactttgccggacatagtgtcaagatctgctcgtccaatagccactgcatcttgaccgtttctggtacttgtgattggtacagtgtatataggacttcgactcgtgttaaggggtgcaaaaatggatccactaatagaaactttgcagccgttagataacgttcatatggcaggtgccgggcagcttgtaagcctgtcacttgtttctgaacaggctggtcagataaatgatagaaatgacgcatggtcgtagtcagcgtcgtgcctaatgtttgctcagccgtgcgttccgccgcatttaaagttgcgattgcagttgccgtccacgcactcgctggacgtgccctgaccatgatgcgggcggagataaagtcatgattagcaatcagtgcgttcaaatacagatctgcggccgcatcggttgctaaatactgcgcttcaaactcactggcatagttagctgccgccacgtattgctgatcagccaccaatgcttggactaactcataattgatggcagccgtttgctgagcttgatacacctgctcccacaaacttgccgccttggaccaatcctgatctcggctagcctgttcagcggctaattgggtttcggctatcgtcattaagccttcctcctcttcattgtaaccaaaaaagtcggaagcaaattccgacttttttaagactaagctttagattcagtctcgactgatttggctggtttagccttcttggtacgccgatgatgctgattaacttccataataactggcaaaataactgggtgccgcttagtctgatcccacaagtaatggttcagcttttcacgaacagcctgttttagatggccccaatcaaactctttgttatcaaggttttcttgcaccgtcgttttgactaactcagcgctttctttcatcaagtccttactagtcttgacgtaaacgaatcctcgtgaagtaatcttaggggtcgcaatgattttcttctttttacgatcgatcgtgaccactgccacgaaaataccgtcttcagacaaaatctttcggtcccgtaacacaatgttcccaatgtcaccgaccccgatgccatcaatcatcgtgtcgccaacttcgatggaaccagccagatgcatagtgtccccatcataacgtaactggtcacctttagcggcaatcagaacgtgatcatcaggaatcccgacttcacgtgcaaagtccgcgtgtgcatccaacagacgatactccccttgaatcggaataaagtattgcggtttcatcatgttgatcatcatttgcaagtcgcgtttggctgcatgaccagaggaattcatttcatcagcaatcgccttaacgtctgcatcagcacgataaatcatatcgcgggtcttagcaactacggtttccatcgaatgtgacggtgtggtcgtaatgaacactaagtcgcctttttcgatattgaccttgctctcctgcttattcgccatccgctgcaaggctttgattggttcgcccatccggcccgtctgtagaatcacaatctgttcaggtttgaatttgtcaatggttttaagcgggacgacaacgtcttccggcatgtgtaacttgcctaaatcaatcgcagtcttcacaatgctttcaacatcaccaggcattaaagcaactttgcgatcagacttcgctgcggcatctaacacttgctgaatacgtaagatgttggaggcaactgaagcgacgataattcgtcccggatggtacttaaacgtttctaatacgtaggctgcgatttcacgctcactgaccggttgttcatagttttctgcattagctgaatcactcagtaacgccaacacacctttagagccaatttctgctaaccgcgcaaaatcagtttgataatcgccggcagctgtcgggtcaaacttaaagtcacccgtgtatacgacctcaccggcactggtttgaagaacgatccccatggaatctggaatcgaatgcgtggtacggaagaatgaaactgtgactgtgccaaaatcaatttccgtcttttcattaatgatgtggaagtcatcaaattttttggctttcggatctttttgcaactgaatttttgccaactcaatcgttaactctgagccaaacaccggcacgttgaactcatttaaaaagtatggtaacgcaccaatagcatcagcgtggccgtgggtcaagaagacacccacgattcgatcagcattttcccgcaaataactgaagtccggaatcacgatatcaattcctaataactcattttccgggtattttagcccgcaatctaaaatataaatatcgccatcgacttcgacagcatacatgtttttgccgttttcacggaccccaccaaagggggtaatttgaattttactactcaattatttcaccttgattcttctaaatgtttaatgttttgaaaagttgggccgtttgttccgcactcaacggcaggattggcaaccggggttcacccacgggctggcctaaatgattcaacgccgctttaactggcgatggcgatggcgcgctaaacagggcactcatcttaggtgttaagtcccgctgatacttagcagccgtcgcaatatcaccctggtcgatggcactaaacatcgcggtcatctcatcaccatagatatgacttgctactgagataaccccagcgccaccaatttccttggcggccaagctctgagaatcttcaccagtataaacaagaaaatcagccggcgcattttcaacgatggcaccaaattcttccatcgtcgcacactgtttgatcccaataatattgggattctgtgctaacgttaagaccgttgacacggccatcttcacaatgactcgcccaggaatattataaataatgaccggtaagccgccctgatcagcaaccgctgaaaagtgcgcaatcatgccggcttgatcgggcttattgtagtaaggcactaccactaaggctgcgtcaatacccttgatctgactaaccttcttagtgaatgcaatggtagcagcggtactgttcgaaccagtcccagcgacgattggtactcgaccatcgacaatctcagctgctttctttagtaaggttaatttttcatcctcggttagcgttggtgcttcaccagtcgtcccacccaccaggataccttgggtgccgtgtgccaataaatgttcaatcaaacttgctaaccgcttttcgtccaattgttggtgatcatcgaaaggggtcaccattgcggtcatcaaatcaacgtttgcaaagttcatgatctaaaagctcctctattaaaatttacaagtaccagcgtacctgttccgattaagtaactctccccagtttaccacattttaaagtaaagcaatagttagaccattcaatgcaacctaatggtaccgttgatggctgaagtaggcgacccacagtatcagtgcaatcagctgtaatccagccgtaacaataaatatcggctggtacccccacaagttagcaaccacgaccgctaagccggggccaatcacgttaccgctagcttgtgcagactgattcaaactaaacacccgcccaaacgctgcgtgtgggacatgttcgaccgtcattacttgaagcgccggtaataaggctgcatccgcaatcccaaggattaaccgcagcccaaccaggagtgcaacctggtgcactaaactggttaacaacaagtcaacgattgctaaaatcaaaaaaataatcagacaacgaccggcaccgagccgatccaaaatgcgaccaacacgaccggccatcaggattgtggcaagacccggcgcagccgccacgattcccgtcatcaagacgatcgtctgcgccgtcgcttggggcgctaactgtccgaccagcaaactcaacagtggcgttatcgcattggtggtcgcttgaacgactaataacgaggtcaataaggcacaaataaaacgcccccctaattggtgcagaatcggacccaacggtggtaatgcggtgcgactcactggcgtcacgttctcctgaacgccccaccaggtcatgacaaagacgagggccatcaaactgcttgtcaccacgaacgctccccgatagccaaccgtattagcaagcacgcttcccaaaagcggtcccatcaatgtaccactgatggaaccagtgaccaatttactcagccactgcccacgttgctcggcgggtgcggtaatcgaaatcagggcgttcgcattattaatgtaacccgaaaatgccccttgggccgctcgcaaaattaaaagtacgaccacgttaggcgctaatcccacgccaagaatcgttaaggtcatcattccagaagctcgcaggcacatcagtttgcgccccttctgatctgccaaccgcccccaaagcggagcaaccaaggctttgcaggcatacgttacggcaaacgccgctgcccctaaaaaactcagctgggtcgtcgaataatcgcctagcgtctgaatatacagcacaataaacggtaacgtcattgcgttacctaaatccgtgatcaagctcccaaaccataagacccgaaaattacgagtcaacgtttgcattgcttccatgaaatcccctcattcacttttgaataaacattagtataacgaacggttgtttgggattaataaagtttatgtattgtttctgtaatttttcgcaaaaaaaagaaccgcccgcaggcagctctcataatttcaatattaacgacgaagaccaagactttggattaagtcacggtaacggttaacgtcttctttacgaaggtaagctaacaagttacgacggtgaccaattttcttcatcaacccacgttgtgaatgaaaatccttcttgtgaacacgtaaatgttcgtttaattcgttgatgtcttccgttaaaactgcaacttggacttcaacagaaccagtatcgccttcgtgacgagcatacttgttaataagctccgtcttcttttcgcgtgaaattgccatgtgtttcaaccacctttccaataattgccctaaactgagtaaatcgttggtggtgcacgaaaaactaagtaaagggttgctgaacacttggtatagtctagcaaactaaggaataaaaagcaagtttcaatacatatcaagataaattactttacacataacggttgcattcaggccggggcttatgtataatagcatttgttgaaaaaatgatggaggtgaatctgatgccaattatcaaatccgctattgaacgcgtgaaaacaaacaataaagcaaacgtccgtaacaccgcccaaatgagtgcgatgcggactgctgttaaaaaatttgaagctgctaaaactgctggtgccgacaacgtcgacgatctatacttagcagcaactagcgccgttgacaaggctgcttctaaaggtcttatcaagcgcaacaaagctgcccgtgacaagtcacggatggctgcacgttacgctaaataagctaattttacgcccgagcattgcgacggcgtttttttattgtcattaataagtcaaaagatggtcgactgaattcttagaattccagtcgaccatctttttatatcttacataaacgagtcacatcatcactatcgtcagtagtggccgtcatcgcttaatcacatctatctaacgagacgaccgcgtcgtgcgtgccgcttgtcgttcattaacgaattgaaccatgaacaactcaaagagtaattccggatcacgttgtgtcgttttcatttgtacttccgtttggagcaaccccaaatacgctgcacgcaacgcggcttgatcaaaatgacggaccgtctgcatggctagcttgacccgatatggatgtactttaagtgtgctagccaggctcccctgactatagcccgcatggaccataattttgacctgtaataacaatcggaattgtcctaataaaatcgcattgattttcaatggtgcttcctgcgcagccactaattcatgataaagctcaacagcgggctgtgtctgataccgaagcacatcattgaccaagtcaaagacattttgcgtcagtgatttagtcactagggcttggactgccgccaaatcaattcgttgcgactgagccgcataaatcattagtttcggtaattggcccataatcagtcccaactgcccatcagttcgattaaccaattcctgtagcgcatccgcatcaatgcggatttgcttctcatctaacgccgcctgcacgtagcgctgcgtttcagcctccgacacttggttgatttccaccgtcgttgcctgtttttttaacgttttaacgagttttttacgtgcgtctaatttctcatagggtgccatcagtaccagaatcgtacttggctctgggtgttcaaaatagtgctgtagcgagtctaaatcatggtcaaccttggtcttcttgttttcacccgtcaaaaaatacgggtgattaataaagactaaccgccgctcaccaaaaaacggtgccgacatcgcgtcatctaaagccacggctactggcgtcgtttccatatcataactgccgacgttcatcgtctgttcttcactgggaatttgttgcgtaaaagcgtgtttgagctgatcggccaaatagtcgaccgttcccaagataacgtagattggtgccaagtcaccgttgcgaatcgattttaacgcctgttgtgcgttgatggcgatcaccttcctttaaaaatgtttgccaacgcccccgttgatgattaatgaaacgataggtaatcatcccctgcaaagccgttgaataagtgacaatatgctgttcagctagagttgttagtgtctcttgattcggatgcccatagcgattgtgccgacccaccgataaaacaccgtggtgaacacctaattggcgcaaagctaacggatccgaggctgttttactgccatgatgccctagctttaaaacgtccacgcgcaattgtgggtatcgggcaacgattgcacgctcccccgcccggtcaagatcacccgtaaacatgaaacgttgctgaccaaaaacacccgttagcaccaacgaatcttcattttcagcccgccccggtttaaatggatgcaccgcaaccaatccatctgcaaacgtttggccggccagtgcttcaatcacttttggtcgctttttagcaggcactagcagtttttgaaacttggtcaggcgcgccattccggcaggtaccaccacttgattgaccggcatcaagcgtaataattcacccaagtcaccaatatggtcaacatccttgtgtgataagtaaactgaatccaggtgagtgatccccagccggtgcaaataattgaccgtaatcatttccgcacgcgatcgcggttgtacctgttctgcctgccaacgtggcctagaaaaatgtagttgtcccccagtgtcgatcaagctcacttggcggttaaatggttggcgaatcaaaatcgaatcgccctggccgacatcgatgaattgaacagcgccgtgaagcggaaaacgcaaactaagactaaaacacgcatatgccagtaataatccacagtaataccgacgttgcggtgtccgtaacaaccacaaactcaataaactgagcgtccaggcccacagcgcactcggttgaccgataatgagtaggccgggccagtgactgacccaatcaagccagttttggaaattagtcaacacccactcacacgtattagcaacattggcagaactaaaaccaatgctagccccaacaactgtcactggcaataggacccaactaaagataggtgcaacgattaagttgactgctaaagaccacagatgccactgcgccgtagccaccagtaggaccggcaagctgatgatctgaatccagatggctaaccgccacggcggtaacccgggcatcaagatcagtaacaatgctagcccatagctaagctgaccgcctaattggctcagaaccaatggattgtgaacgatccccaccatcagagcaacgctccaaccgctcagcgccccacttgactggcgcgttaacagttgccaaacaatcggcaaggccgcagttacaaccgctcgttgcaagctatcggccccgccgcccaacacaaggtatgctggtaagagccctaataaccaaatatcgattgcttgatgacttagatgcagtcgtaacaagacccattgtaagaagttaactaataaaataacatgcatacccgacaaactgaacaaatgcaatagtcccagctgttgtacggcccccattgtcgtctgaaaatctgcggggcgcatcccaaccagtagactcgtcgcataacgactaagcgttggcggcaatctttgacaggctagaaagaattgctgacgccattggtgtaatcgatcaagtggacccagccaaccacgccgcggcgcaatttctattcgttgaaccgctgtgaccgtcacttggcgggcgactccttgactacgataataccgaggcgcattaaactgccctgggttggtcggaggtgcaatgggcgctaattccccttgaacacgccagactgtccggcaagtgagctgagtcaaatgctgtttttcagcggcatttttcagctgacctctaacgaggagtttgcccattggactggtggtaatcagctgatactgaccaccgcgcaccgtaatcgcatcaggttgaacggccaagtcgagtgcgaccacctgactaggttgttgaactatggttgtgaaacgatgattttgccaatttagccaaattgccatgaataccacacagccgattgtcgccatcaaacagtatcgatctcgtaagcggataactcgcattaaccaaattactaataatccagctgccagccattgttggtcaactaaccaactactaagtaggccgcaagcaatagcggcaaaaaatagtgcgcgcaattagtcacgatctaataagatttggtcaagattcagtttatccaagtctgattggtcaaactgcacttgttgtaaagccacgtgtttgcgctcaattaacgacatagcgtacgcatcgttatgataattacgtaaataatgaattttttgaattccagcttgcaataacattttcgtgcattgtaaacatggaaagtccgtgacataaatctcggcaccatctgtggccgcaccgaactttgcacattgcaaaattgcattcatctccgcgtgaatggttcgaacacagtgcccatcaacaaggtaacagccctcatcgatacaatgaacatcgccggataccgaaccattgtaaccacccgcaataatgcgtttatcccggacgatcgtagcaccgaccgaaagccgttcacacgtgctccgactcgccaataagacggcctgcatcataaaatactgatcccatggaattcgttgatctttcatcattttatgcctcactttcaatgacagtagtataccaaattgtgcgctttgaaactagacggtgagttggtctttgtatttagccacggtcttttccccaaagccgctaacgtttttcaaatcatcaatcgttttaaaattaccatgttgctggcgataatcgatgattttttcagccttcttctgtccgattccactcagcttttgcaacgcggccacatcagccgtgttgagattgaccttatccgttgccgcatgatcactagttggcgtcccaccagtaggggccgttgacggcccaaccggtggcgcaacgactggcgcctgttcacccttaaccggcacgtaaatcacttgttgatccgtcaccttggcagccaaattaacttgccgaacatcggcttggggctgcatgccctgtgccagttgaatgacatccgcaacacgcatactcgctgtcacttggtatagtcctggtttgttgaccgcacccttaatatcgacatatcctggcgaactgtcccccgccggatgggccgagctcggcgtcgcattcgacggctgggtgctcgtggacggtcggtcaccacttggttggggctgactcgtagcccccgttgatgtggcactaatcgagcgtgccaataagttatccgtgttggcgggttggggctgtttaagttgactaagggcccacccggttatcaaaataatcgtcaccgcactcacaccgccaacaattcgccagtgtgttttaagtagcttgatccaatctatcattcattttcaccccttcaacgaacagttatgcaaagggggttactgcccatgaaaaaagtttgggttttatcccaaacttttttcaacttacatttcaattttactgtgggagggtctgcaaataacgaacggcctgcttaaaagacgtcactgggacgactttcatatttggcgcgtactttttcgcagtcgacttagcgagttgatagttggtttgacccttctcttcaaccgccaagagcgctttggttggtttcacgtacggggcaaagaaaatcgtcgcgcccgcccgcttggcagcgatcactttcttgtcgataccgccaatctcaccaacttgtccattttgattgatggtaccggtcccggcaatcttgcgtccgtgtcgtaagttctgattggtcaattgctgataaatttgcaaactaaacatcaagcccgccgagggacccccgatttgtccgggatcgaccttgaccggaatagtcgtcgttactttaatattatcagttagaccaatgccaatcccggcacgatgggtgcttaacctgatcaatggcgcacttgcttgcttcaagtgcccctttcgccgatacgtgatcgtcacacgatgtccgacaccctgcttaccaatataatgctgataggcactggccgtattaaaatggtgcccatcgactttcgtaatcgtatcgccaacttttaattggtttttaaatttcgaattagactgcaccgttaaaacgtagattccctgataagtcttacgatattgctgatgtgcggctgagtacgctgtcgcgatggcttcattgatcgcactctgcatataaaacttttgcacccgattataggtcgcgtcatcctgcccgccagtcatgtcctgagcactgaccacgtcatagtggggattcaattgcgcgtaaagccacaacagcggcgtcgcccgagcttctgcgaccgaggtcaacatgaacttgcccgaatgatgatctggatgacgcttgacggtcacgaaggccttcaaattattcgcactccccggtccttcaacatagtatggtaaaggcactagaaatagtgcaagcaccaccagtatcacgaccagcaagccccagtaacgttttaacaactcccggcccttagtcatgctgatcagttcctaaccgctgatggagtttttgcgccaccgcggtcgggacgtacttggaaacgtccgcgcccatcttggcgacttccttgattaaactggaagaaaaataggcgtacgggggccgtgcaatcaagcaaattgtttcgattgtctcgtccaatgacttgttcatccaagcaatgtcacgttcatacccgaaatcctgttcattccgtagtcctcgtactaggactgtcgcatggacgctcgccataaaatcaacggtcaagccagtcgcagcttgaacttcaacgtttggcaagtccgcgacctcttcgctgatcatggcaaccttttccgtcatcgtaaataacggttgtttgctcgtattgaccatgacggcgacgatcaatcggtcaaccaatcggctcgcccgttgaatcatatctaagtggccccgcgtgattgggtcgaaacttcccggaaaaactgctgtcaccatacttacccgacctccgttactttttggtaaatggtaatgaccgtaataccgtaatcttgttgtctgatcaactcaaaccccggtaaggtggccggtaagttcgcattcgtatccgtctcacagataatccgacagcccggattcaacaatcctagtgcatcacaatgctgaatatccttcacgatctgttgcttggcatagggcgggtctaaaaacacccagtcaaaatgttcatcttgagcggctaaccggtccaaaatgcgttcggcatcgcccttgatcacctcaaatcgttcgggcgccttagttacggcgatgttatccttaatcgtcttgatggcctgatactgccgatcaatcagaacagcccgagccactccgcgtgaaacagcttcgatactcaaaccgccgctcccagcaaataagtccaaggactgcccaccatcaaaatagggaccaataatattaaaaacagcttctttaaccttatccgtcgtcggccgggtctgcatgccgggtacggctttaagccgccgaccaccaaagtctcctgctacaattcgcatctcatcttcaccaacttaatcctcatcatcatcatcgtcatcaggtgcaccggtcgtggtgggcttaaagaagccttgatccacccgttcaccaaagttcattgcaacgtccgggcggtatgacggttcaaccctgcggacaaaatttaattttttgattttcgtggttgcggctggaatttgattttcatccatgtacaagaccacataatgttccttacgcgattggtattgaattaatccaaagcgtttcaattgacgcacctgcttcatcgaatgcatatacacgatgagcgaccggcgcggtttaactgtaaaatccatcgaacctcacctcttctacttgcgttgctgtttaaatgttaggctagattcagcatttcgtcaactaggttcttgcccgtgccgtagttttatcgacgcaacgctgaatccaaaaaatcactagttgcctgagccactagtgattttgttcaaaatagccttattgtggtgcgatttctagcagaaggtcatccgtttgaatgacgtcacccgcattaacataaatatgttcgatgaccccatcttccggtgcttgaatggtggtttccatcttcatggcttctgtcacaagtaatggatcacccttcttgactgtttggcctttcttgactaacagtttcagaacagaaccgctcattgttgccccaacttcatcctcgttagttggttccgccttgcgcgtgctagttgccgattggtgaatcgcattgtctttcacggtaatttcttgattttgaccattaatactgaagtaaagcgtccggacaccatcgacatcgggatcactgatctgattgagtttaacaatcatcgccttaccttttgctaactcaatattgaccgtttcgccaagccgcatgccttggaagaaggtcggtgtgtccaagagtgacacatgcccataacgcttgtggctagcatcgtaatccatgaagaccttcggatacagaatgtaactaagcacttcctgatggcttgcttcatggccaagtttagccgacaattcggttttgactgcggcaaagtcagctggtttagctaaactaccaggccggacggtcaatgctggatgatctttcaagatgatctgctggagcttctttggaaagccaccgactggttgaccaagattaccagcaaagaagttgataaccgatgctgggaaatcaagtttggctccctgattgtaaacgtcatccggtgtcaggtgattttccatcatgaacaacgccatgtcaccgacgactttggaacttggcgtaactttgataatatcgccaaacatgtcattgaccgtcgcatacatcgtcttaacttcttcccaacgatcaccgagaccaactgccttggcttgttgttgcaagttggagtattgaccacccggcatctgcgtctggtaaatgtccgtttggggaccagtcattccgttcgagaagtcttggtagtacggccgcacaccttgccagtagcgattgatagcttcaacattgttgatatcaacatcgggttgacgatcattgtgggctaatgcgtagtataacgaactcattgatggctgactggttgtgcctgataaagcactcgcagcaacatcgaccacgtcaaccccagcttctaccgcccgggcgtaggtaaagattccgttccccgtcgtatcatgcgtatgcagatgaactggcacggacagcgtgtctttcaacgtcgataccaattcgtaagcggcctctggctttaacacgcccgccatatccttgatggcaataatatcggcaccagttgattgcaaatccaatgctaactgccggtaataatcaagattatacttctgccgatcaggatccatgatatcgcccgtataacaaattgttgcttccgcaatcttaccagtctctttaaccgcctgaatactcttttccatctgaggaatccaattcaaactgtcaaaaatacggaagacgtcaatgccactcttagctgcttctaagataaattcgcgaatcacattatccggataattctggtatccaaccgcattggacccacggaacaacatttgaaagagtgtccggggcattgcctggcgaagctctttgagtcggttccacggattctcgttgaggaagcggtaggcaacgtcaaaggtcgccccaccccacatctcatacgagaatagctgtggtaacgccttttgtgacgctgccgcaacggcgagcatgtccttggtccgcatccgcgtcgcaaacagactttgatgtgcatcccgcatggtcgtatccgttaacagcacctgcttctgggctaacaaccactgttgtagtccctgcgcaccttgctgatctaacacgtctttggccgtgacgatgtcgggtgcgatcggttgaaagtcgtccttgaattcaacgtccggatagtacttcttcgaatgctgggcaacgtcagcgaagccattgaccgtcacatttccaatatacttcaacatcttatcttcacgttgcgtatcgtcaggaaatttgaagagcgctggggtctgatcaataaaccgagtccccgcttccccagcttggaacgttgggttgtcaatcacattcaacataaatggaatgttcgtcttcacaccgcgaatatcaaattcaaccaagacgcgccgcatcttatgaacagccgctttgaagtttcgtgccgccacacaagccttcacaagcagtgaatcaaaataaggtgttacgattgcaccggaataagtattaccggcatctaaacgaaccccattaccaccgggcgaccggtacgtctcgatacgaccagtatccggcataaaatcgttcgctggatcctccgtcgtaatccggcactgaatggccgcgcccttgtatgtcagggcgtcttggtgtggtaatcgtaaatcctcgaataagtcgccacccatcgcaattttgagctgcgcgtgaacaatgtcgatttcggtaatcatttctgtcaccgtatgttcaacttgaacccgtggattaacttccatgaagtagaactggtcaccttcaaccaagaattcaaccgttgcggcgttcaaatagtggacgctcttcattaagtcgactgccgcattacaaattttttgccgcaattcgattgggagggccacggccggtgcaaattcaatcaccttttgattacgacgctgcaccgaacaatcacgttcgaacaggtgcatcacattgccgtgcgcatccgctaaaatctggacttcaatgtgcttggggttggcgatgaatttttctaagtaaatctcatcatcaccaaaggattgcatggcctctgaacgggcacggtcgaacgcttcttgtaattcagaagcttcgtgaacgatccgcattccccgaccaccgccacccatagcagctttgatcataattgggtaaccgtattgctgggtaaattgtaacgcctcgttcaagctagtgaccgggtgcaaggtacttggaatcgtctgcacaccagcatcacgggccacccgtttggccgtaatcttatcaccaaacatctcgaggtgctctggcttcggacccacgaaggtcataccttcttcagcaatccgccgagcaaaagtagcattttcagataaaaaaccgtaacctgggtgaatcgcatccacatgattttctttagcgatgcgaataatatcttcaatatccaggtaagccgcaatcggcgccttaccctcacctactaggtacgcttcatcagctttaaaacggtgaactgaaaactcatcttctttggcataaatcgcaacagtttgaaggcccaattcgtgacatgcacggatgacccgggtcgcaatttcgccacggttagcaattaatactttcttcaccaaaatccctcatttccaaataaaatcgtcttagcctgcctgtcgaaccgtatcaaggcgcgccattttttcaagtgcgctgatgtttaataccaaccctaatgaaagcgtcaataccatcatgctagaaccaccataactcatgaacgggaaggtcaccccagtaattggaatcaaaccaacgatcccaccgacattaataaatgcctgaatcgtcatgtaggccgcgaccccgtaacagaccaacgcgttgaacgtattagtcgcacgaacaccgatatagatcgtgcgcatcacgatgacaagtagtaagcccattatgagtaagatgccgattaatccgagctcctcagaggtgatcgacataataaagtcagtgttcggttcgggtaaatagccgcgtttttgcaaactattcccgattccgacccctgtcaggccgccatttgagatggcatagtaagagttgaccagctgcgtcccagccccggaagccgtcttaaacggattcaaaaaaccgaggaaccgccgtaactgataagaatttgcaaaagcactctggggtaagcgactcactaggggaactaagatccactcaaatgcggcaaccgccccagcaaagacaccaacacccacaaagtatgaaatgccacttgcaaacaaaataactgccgcaatggctaaattaatcgtggcgccaccaaggtccggttgcacaaaaatcaataaaatcatcgcgaataacatcacaaactgagcacccaattcccgcatccgggccaccccaaaatgcgcctcacgttgagaaatgatggatgccaagtaaatgatcaagtaaaacttacaaaattcagctggttgaatcgagactggccccaaaatgatccagccagctgccccattaattgattggccaatcaatcggagaagaaccaaaacaaataacattgcaaaccctaatataccaagtaacctggtttgcttaaaaatgtcgattttcaaattcatacaaaccaaggtgatcactaagcctaagacgacccagatcagttgtttaactaaataaccggtgggtgtcgaaccgttttgtgcggctacgtatgaactcgatgaatagaccatgactacgccgattccgctgagaatcaaatacgggataaacagcacatagtccatatagtgcaactttttccacatgagcttaaatcccaccctaattaatatctcaattcgaattattcccacgataacgcgaactgtttgcttgcaacaattatagcataagtcgattttaacacagcattttcacatattaatttgttgttttttaatcaagttgggatgactgatttacaaaccggtgtcttttgtccaaaatgcacttgattggcagcacctatcgtcctgccccttaacccgcctcacagacttacctttggccactagtctagtacttgattgcgatgaattgaaccgtattggcactcataatagcggtgataccccaacgcgcgtctaacttcacgatgaatcatgtagacgacaaaatagccgtgggacgcctgatctaggcctcaccacagctattattgctttactcacaactcacttgcatcaatcacgggtcacacgtcctgacgattgccggctcactcagcttcatctgccgcaattgccgcttgcaatttacgttgataccaatccacgacgcgccgaatatttacaacggcccgctcaaatgagaacacaccaagtaataataaacacggtaagtactggattaaataccgactccgaccaccttcgaataagaggaggaagataaagccaccaatcatcgccaaccggagtagttgaagcaactggcgacgtggcccaaagcctaacgcaataatcacgagtaatgtgatccaccacagttgcgccacgaatcggaaatccgcaatatggcgaccgtataaataaataaagttttttaaccaattactaaaaccctgatcacttggcttttgattttcgcggaagaaattaccctccttcaaccagccaaaggttccatcagcggtattgttgcgttgcttttttaccaaaaattcaaggtagccccacggtcccagttttttgagttgtcgcttcagcatcttgatcgaatacgccgttttttgcgccttggttggcaaaacggccatctggatcgcctgcttttcactgtacccaccggagccgtaaacacccatagccataaaatgaatcgccggaatcgaccttgatttatcgattttgatatacgtctggttctgaatggcttgatttgtatagtgataagtgataccggcactttccagcatcaaaattgccatggcgaccgtcacaaaaatcatcgtcgtttgtgaaccctgccgcgaccgcaaacgtgctaaacagctgatgatggcaatggcgattaccggaataatcgatgacggtttcatgaagtacgttaacgtcacgcttacaccaaatccgaccgcagctgccacacgcagtaacggcggtcgcttcgtttgactcatcacgaaatagcacagcataaaaaacgagaccaacggtaatccccaggcatccgtatacggcatgatgatactgggaaaaaccgccaaccacccggcatgcaaatacatcgcaatccctaacgctgagcgccgaaccaccaacacgctcagtatattgaaggctgctgacaaatcaacaaacaacagtgtcaggtaatcaaagaattgccacgacgtttgccccgtcacttctgatagccagtgcataaagagcatgattggcatgttattttgattaagactataatacgccgtcacgcccacctcttggacgtgcttcgcactggtagcggcgtagtggagcatcccagcatcaaaaccactgacgggatggacaaaggttacgaacacgatctgcccaatgaaaacaagggctagcaacccacctgccgtccgaatctgatgggtgatcaatagtcgatatagcccccgatgaacgcgtggataggcataattcataatcaacacggccacaatgacaataatcaaccccgtcgtcaacaaggtcgtactcgtcccaaaggtggcattatcccctaagataatattcggcgatatcacggcaaataacagcattggcgcaaatagtaaccaccaaatactcgtaatcattttttgactaaattggtaaatataacgtctcatcgttactctgctttggttgaaccggcacatttttggactgcaagatcaggatttcctccccactggacttgagatcctatcaccagcagatgtgtcgctttaactcattttcctttccggcgttgtcgataatgctgccgaatcgtgtgggcatcatcatgtaaaactgcccacacccgctgccattcttcggtgaacccccgcatcttccaagctgcctgagtcgtcatcgcattgataacaccaatcaaccgaatccacgcggttaaaaacatgtacagtggcaacgtcaacgttaaccaccataagtgcaaataaaactgctgctccttgggataaggcttcagtaagatgcccacactaataaagttgattgcatccaccaagacgtacagcccataaatcaagatataagataagccgacgaccaccgttgaataaccaaaggcaatcaaaacgatggtcgcaaacgtccaaatcatgcgtggaaacgtgaacgtgtggtcaatcatgatccgccgaacgagaaagtctttgaaaaagccagtaatactagcagtttgggacatatagtgctgagcaacctctaattcgccgcgttgccaccgctgccgctgggtatataactctgaaaagcccgaaatgggtgcgacatagaaaatcgcattcgcgcaaatcacgactttcttacctagtcgagttcgaatctgaaacgtcatatccgtatcttcaccgatcgtatctgtatcgtacaaaaaggtctccattagcacttcacgtcgaaatgccgaaaaggcgcctgacatggtgaacagttgatcacgaaacgattcaatggtccgacctgaaagaaaggcctgggcatattcatagtactcgttcttagccaataaccgatgccaccagccggaaacctgtttgactaactcccgctgtggtaatactgctccggtcatcgccgcaatcgactcgtcactttcgaaccgcaataccatgttcttgaccgcattcggttccaacaagccgtcgctgtcaatattgatcacataacttccaatactctcataaatcgccgcgtttaatgcacgcgccttacctttatccgtattgacatagcgcagaaataaattgggaaatgcattctgagcccgggcatatgccccaaagctatcatcagtactctgattgttggcaagaatgatttgcatggccttcttatcatacgtttggttatcaatcgagcggatgcagtcaaataaggtatcttcagaattataaaccggtacaataatggttacccacggccacttttgcggcgcttggggctttaccgtttgtcggtgcaaatacattaacttgattgttgacaggatggcgggaataatctcgactacgatcggtaccaaggcccacgtgatccaaaatcccattctggtcagtgccagatttagccagtacatcacagtatccgatccctccaatcaatgaatcgctgataaagcccccgggccaattgcgaataggtaaagacgttgtaatacaagataataacgagtacatagaacaacagccgtccaatcaccgaatgggccatgaagaatgattgcccaccaccaaaatgaacgatgactatcacaacgatgagtcgcagaacattgatcaagtaaataaacaacagtccaaaaacgccataaaacaccttctcgcggcggtgataggcggggtaaaaagcgaccaacgaaacaaacgcacaagtttcgataattccggaacactcataatcgatcgacatgacgactgggttaccactattcgtaatgtagaccaatcccatcttaaacatgatgtggcaccacccactcacgtcgctaaacagcgcaacaccatgaatcacagcatgggtaaagaaccacacccaatacgggcgactaattgcggttaatataaaaaagagcccggcgcttcccacaataaaagagaaagcagatagccgagctcgtttgagcactgacagtccgtataaccatatcagaatccctagtaggatttttacattcatcgtacacagtcctattaattagcttaccgacgcgcctcagccgtcggtggttatgaattgattgtcagtaaatttggtgtcattaattcaatagttatcgattcaatccacactttgcacgttaaactagcttgaatcatgattaaaacgtgccaagtttagattgttgttcgtcagccggtgatcatcctattccgacctccggggctgggtgacaattgctggaacgcagccgacgtcgatttgagcccgtgcacaacccgcccggtctcaaatacgagtcttattctaagccggaagaaagtcacttccagctaagaataatttggctactgagcattgtcacccagcccctccagtcggtaagccgctcgaatggctgatgaacggccacttaacttggtacaattggtcgttggccattttgataatggaactttaaacgagacgttagggttacattaactactttgtcgaaacgttcgattattactatgatgattccgaaatagtgagctatcacaacgtcactttctgcctgacagttaattgacaaaattgctttttatgaagaacaacaaccaattcatcaaaagttgggtacatcgccgtccgccattcgaacactgtcccgactggaaggcgtttctgacaatgctcagcggtgaaattccacttagcaagcgtcttgtgcttggttagtggaagaccagtatttaagacgtgggcttcggcttaaatctgtgtccaccgcgttccagcaattggcagaaatgcctggaagtcggcgtaggacgcgccaactaagtaattttacgctaactcgaactttttccagcgggccgaagctgggtgctcttgaacttacacagcttggcacgttttaatcatagttaatgctaaatcataacgagtataacgtgtaatcaagcattagttcttagtggtcgatgaatccgttgcagttaatcgacgccgcttgcggaatttaaagtatccccaagcaacgattacgacaccgacaccggaaattacgtacggaccagttgagccaccggctacggtcattttttgattaccgatattcggattggtcatcgtaatcgtttgaccagtcatcgttgaaatatcaaatttgctcaaattcactctgaattcagcaatcgaatgtgaaccggattgagaaacataaccattaccgaccgtgccgtactgatggccctcattgttgctaccacccgtaaataagacggctttgaccgccccgtcactttgcgagctaggcatctcattggaccacacgtaatacttttggccgctaatgtcgaagttataatccccgtaaccgggcacctgcccatacttcatcttgacataaacgtagacgtacttcccgtcactgaccattgccatatagccgttataaccctcggtcagagtcacgtttttccagtcattaaagttaccatcgattttaatattgagattatcattgtcattggccgcattattgtccgtcgtcgaagacgccttagaagcggaggtatctttatcagtaatcactccagctgaggaactagtcgcattattagcgctggttgtggtgcttgaacttgcagcactggaactggtcgcagaatttgcattagtacttgaactagtactgctacttgagctagtcgaagacgcgggaattgttccaactgtactagtagtaggagcattaccgatgttcagattgaccatcgaaatctgcttaccactcgcactgtcacttagtcctaacttggttaagtcaatttgaaattcggcataattatgcgaaccgtcattggtcacatatcccgttccgacagccccatattgtgtgccttcattccatttaccaccagttaatgtgaaggacttgaccgttcccgagctaacactacctgaaatattcttagaccaaatataatacgtcttaccatcaatagtgaaattatagtcgccatatcctggcacagcaccatttttcatcttgacgtaaacattgacatactggccagcactcgcgagtgccgtgtaaccattatagccctccgttaacgtcgcatctttccagtcgttcatcttgccatcaatggtgatattggtgctggcatcggcggtagttgtcatagcaggattaattgtcgttactcccgttatcccaaaaacgagcatgcctaagatcatcaacttattaatttttttcacgatggtcacacctcccaaattcaataccattttgcggggtcataagtgtcaatggaccttttttaccctataaactaataccatactctgaataacattttatcaatcattatttccatttaaatgaacactgtaaccattagtgcggtatggattaactttgccgacttcctcccgttcttgggtggtaccacctgcgacaaagtggcacaaaaaaaaacgccctattaaggacgtgctttcgagtaatcaacttacttgttcattttacgctttttagcttctttttcacgggagttcgtgttcaaaatacgtttccgcaagcgaacatgttctggggtaatttcgcagaattcgtcactattcaagaattcaagcgattcttccaatgtcaaatgcgttggcgtcttgattgtcgccgtcaaatccttgttagaagaacgcacgttggtcatgttcttacccttagtaatgttaactgaaatgtcattttcgcggctgttttggccaacgatcataccttcatatacttcggtaccgggatcaacaaaaatcgttccgcggtcttcaatacccatcgtggcgtatgtcgtggtcttaccctggttgattgaaaccaaagcaccgttacgacggcctgggttccagttaggaataactggcaagtattcagagaacgtatggttcatgattccgtaaccacgcgtcaatgaaaggaattcagttgaataaccgatcaagcctcgtgaaggtgctaagaaagttaaccgggtttggttattaccagtactttccatattcttcatttcagccttacgctttgataaggtatcaataattgaaccagtatattcatctggcgtatcgatttgaaccgattcaaatggttcgcaacgcttaccatcaatttcgcgatagataacttctggacgagatgcttgtaattcataaccttcacgccgtaacgtttcaattaagattgacaaatgcaattccccacgaccagaaacgacccatgaaccaggttcgtcagtatcatcgacccgaagtgaaacatcggtttcaagttcggccttcaaccgcatttcaagttgacgggcagtcacgaacttaccttccttaccagcaaatggtgaggagttcgtgccgaaagtcatttgtaaagttggttcgtcgatccgtaagatcggcaatgcttcaggattggctgaatcagcaaccgtttcaccaacgttgatatcttccatcccagaaacggcaactaagtcaccggcgtgggcttcattgatttccaaacgttgaagaccgaagaacccgaataacttggttacgcggaaattcttcttgctaccatcaagcttcatgacagacacactgtcaccaaccttgatcgtaccacggaagacccggccgataccaacccgaccaacataatcgttgtagtctaataaggccacttggaattgtaacggttcgtcagagttgtcaattggtgatggaatcgtcttgatgatcgtatcaaagattggttgcatcgtgtgttcctgcttagcagggtctgattcgtaactagaagttccatttaaagctgaaacgtaaactactgggaagtctaattgtgattcgtcagcacctaattcgatgaacaggtctaacacttcgtcaacgacctcttcaggacgtgcaccgggacggtcgattttgttaataacaacgattggtgttaagtgttgttccaaagcttttttcaaaacaaaccgagtttgaggcatcgttccttcaaacgcatcaacaacgagtaataccccgtcaaccatgcgcatgattcgttcaacttcaccaccgaagtcagcatgtcctggtgtatctagaatgttaatttgtttgtcgccgtaacgtacggccgtgtttttcgaaaggatcgtgataccgcgttccttttcaatggcattagtgtccatcgcccgatcgtcaatctggacatgttcgtcaagggtatccgattgtttaagcatttcgttaaccaacgtcgttttaccgtggtcaacgtgggcaataatggcaatgttgcggatatcatctctaaatttcaaaattgatcttcctttcatccttcaaaattctggctatcatcgacagcagaaatcttacatatattaatacaatccgccgttactatcaagtcatagcttcaacttgaaaccttcataacgacgttttcagcggctttcatccattgacataaaaaaactgtgacatatgggtcacagtcccactacttactagacgattgccaaaattgagcgttgtgcgcgctttgtcgctatcagtacagcacccgatgataacatattaaccgggctgccgtcaactcttgacacaactagtccgaggctttcagcgagaacccgaccagctgcaaaatcccatggtcgcaagtatgacagataaccgactagctcaccagctaaaacctggctgatttgaatacccgcactgcccatgattcgcgcgcccagtgactgtgcaatgacagtctgcatattgaagcggtcttgaatcaataacggggcactcgcaccaaacaaccccgcactcaagtcgacatccgcgggtgcagccaacaactgcccgttaagcgtgacgcccacttcaggaccgccagcatataatttattcgccatgacatcaaagatataacccagtgttggttttccgtcaacatacaaccccaccattatcgcaaaatggtttcgctgatgcacaaaattcatggtcccgtcaattgggtcaacgatccagacatgaccagtcatatcagtaacttggtcgccggttccttcctcagctaaaatcttcgcaactggatccaaggcgcgaatttgacgtaccaaaaagtcttcattgctatggtccacgttagtcaccaaatcacgccgactggtcttctccgcgaccattaagtgggttcccattttcgccaatacttgccttcgcgccgtttgcatcgcggcttgcatgttttgatttaactgtttcaccacattcgtttgcacgttaagtcacctagtctcggtattgaaatcgctgtttgttcgtctcctgagccgccagcatcgtttgatagattcgataacccgaggcagcctcataatcgcgagccagtcgcttttcttccgatttggccggaacaaccgtcttaaattcacgataagccgccagcaaatctgccgtagcaatcgacccttcattagcggcttcgatagcttggtaaaaggtcgtcactttaatgatttcggcagtggtccacgtctcatcaagtgggtactgataattatcattatttttaggcatcttcatccaactcccccgctgtgacccggtcaagttcttcacgaacctgacccgcaatctcagcgtattctttttgctcgtcatcagatagcaccatatccgccatgcgtttgattccgttagcgctgatcaacaccggcgatgacaaaccgacaagctggtcgtcatcgacaagtgtctggatatttgtcacggtaccgataaacggcgtctgcgcgtaaaacgcattgagtacttgtactaatgctaacacactcaaggtctgattagtaacaatcgtggggtcatcgatctgctccgtcgctgcactcatctcgtccatcccaaaactgatatcctggttagccaagtaagtcatcacgggcgctggtccaatatatgagcgactccatgagattaggtgtgccgccgcagttccaaccacgaatgcacgcacatccgctggaccaacacttaattgctggcgtaacagttgctctagtaatcgactctgtggcaaggtgcctagtccgactactttagaatgatcaatgccactaaaacgtgcgaccaaaacgcttaaaactgcgtcattgctaccagccaagataatttttccgttaaacccggcgcccatcgcatcattcacgaatgtgcgaaacaacggcagggtcgcctttaaatcaccactggcatcacgatcactagccaacggtactaaatttccaataatcaagctatctgcttgcgaataatctggtttagcctgtgcagctaatgtaaactgacgacaagttaaactcgcagtcaccagcgcttggtagcgtggcgcttcgtcggcacccgttgcgaccactaatttcactggcaaatctttggcaattgcgactaatattaattgttgtacgaactcgaataatccccgaataattactgtattaatcatttcaatccctccaaccttcgataataattgtacctgagctgtcaatgaattcaagtaaatgttaacaaaaaacttacccttttgtaacatttatgcccaaccaatttgccacttgcccccgaagcaagcgcagtttgatgcttcatcgtcatagaccactgtgcacgtaaaagttagcccgttcagtcacgatatttgtgccggataccaaggttgcacgcaccgtttcaattaggcaatcttgaccaacccagctttcaattttttctgagcacgttttaattcgcgtttcccatgcagctcattttaaagtggtacaccagctaccacatcctatgtaaaacaaaagtttgaggcgctggcctcaaacttttattaagtcatcatccgctttagatatgcgttgggtaacccatcgcttcatccgcagcttcttgaactacttcacctaaggttgggtgtggatgaatcgtcaaagcaaggtcttcgacgttcataccaccattgaccgcaacacttagttcagaaatcaaatcactagcacccgggccggcaatttgagcgccgacaatggtcccttcgtccttcgtacttacaagacggaagaagccgtccattgagttcaaggagatcgcacgaccattaccagcaaacggaaacttggacgtcttcacttgtaagcccgccgcttcagcttcagccttcgtcatgccgactgttgccaattctggatcagtgaagcacactgccggaattgaaacgtagtcgttcgccgtcttcttgccactgattgcaccagcagcaactttagcttcagcaaacgctttgtgtgccagtgcggcaccagcgacaatgtcaccaatcgcgaagatatctccagcagccgtccgtccttgttcatcaacttcgatcaggccacgcttcgtcaacttgacgtcagtgtattccaagcccatgtcgtcagtattagggcgccgaccaacggtgaccatgacatagtcagcatggatctcagtttctttgccgtcaacggcgtaggtgaccgtgacaccactgtcatcttgttcggagtttttcgccatcgcattagtgatgacgtcaacacccttcttcttgaagctgttcaagacaagtttgaccatgtctttttcgaagttaggcaagatttgcggtgttccttcaagaatcgtcacgtgagcaccgaggttggcataggcaccagctaattctgagccgatgtacccaccaccgataaccactaattctttaggcacttcgggcaaattcaggccacccgtcgagtcaacgacccgaccactaaacttgaagcccggaatttcaactggccgtgaaccagttgcgatgatcaaatgtttgaatttataagtctgaccagtatggtcgccattcatcacccgtaaggtatgattgtcatgcatataggcttccccacggaccacttccaccttatgcttcttgagcagcatttcaacgccaccggtcaaccgatcaacaacttgatggtctttccagtcctgggtcactttaaaatctaacaccggatcctgaatatttttaataccaaagatcttactgtccttggcttcttgtagccgatgaccagcactgatcaaggctttggatggaatacagccaacgttaaggcagacaccaccgatatattccttttccaccacggtgactttttggccgagttccgcggcccgaatcgcagcgacgtaacccccagggcccgcgccgatgatcattgtatcgcgttcttcagcaaaatctcctacaaccattccgacctcatccttccatcaaaagtaattctggatcatgtaacaattgcttcaacaagttcattgcccgttgtgccgttgcaccatcaatcagacggtgatcaaaactcaaggacaacttctgcatcttaccaacaacgatttcaccatcgtcattgacgtaaggttccttaccgatgcgaccaacacctaaaatagcaacttctggttggttgataactggggtaaaccagccgccaccgattgaaccgatgttactaatagtaatggagccaccactcatttcgttggcctttaacttgccgtcataagctttttgcgtattgtcagtaatctctttggcaattgcaaacaagcccttaccttcagcgtgcttgatatttggtactagcaatccgcggtcagtatcggtagctaccccaatattgaagtagtgtttgtatacaatttccttattcgcatcatcgattgacgcattcagttctgggaattgttgtaaaacagcaaccaaggctttcacgaagtatggtaagaaggtcagatggatgtcacgatccaaagcaacctgcttgtacttcttccggtgagccatcaacgcactcacttcaacttcatcaaatagcgtgacgtgtggcgcagtgtgtttactgttcaccatcgctttagagatggccttccgaatcggcgtcatcttttcgcgcgtctctaattcaggtgtgtcagaaacgtatggtttaactggcgttggtgctggtgcttcacttgccgccgaagccgtttcagttgttgtagcagctggttttgcaccggttgctgctggcgcacccgtgtaattgtcaatatcttgctttgtgatctgaccatgggcaccagtaggcgtaactaacgtgatatcgatgtccttgtcacgtgcgtactggcgaactgatggcattgccaagacccgcttgttaggatcgcccgcagccggggtccccgttggttgtgctggcgcagcagctggcgtttcagcagcttcacttgccggtgcatctgccttcgcaggggctggtgtttcagccttagccgctggggcagcgtcgccggaaccatcgtcgatcgtgacgatgacatcaccgattttagcggtttcgccttctggaactaaaatatcaatcactttaccacttactggcgatggtagttcttccaccgatttatcattttgaatttcaactagagaatcgtcttctttgacttcatcaccaggttttacgagccatgatgcaatttcgccttcttcaagaccttcaccaagctctggtaatttaaactcgtaagccattggataacttcctttcatgacagtctcaggtgactgtttttcgatgccgcgtcctgattaatagttcaagatttcacgggtttttgcttcaatttcatcttcagctggtagccaatcgtcttctgctaatccgaatgggtagaccgtatctggtgcgtacacccggccaactggggcactgaggtaaagtgcacccttttcagcaatcagtgaagcaacgttcgctgcaataccagcttgacgttgcgcttcttgaatcgcaacggcccgaccagtcttttgaacggacttcagaattgtttcttcatctaaaggtgacaaagtccgtaagtcaacaacttcaacggagatgccttctttttcaagcttttccgcaaccttcagtgactggttaacttgtgcactgtaggcaatcaaggaaatatcagtaccttcacgaaccacgttagctttgtctaacggaacggtgtaagcttcatccggaatatcggccttcattgaccggtataacttcaagttttcaaggaagaaaactggatcattattccgaatcgaggaaatcaataaccccttggcatcgtatggattagatggcgttacgacccgcaaaccaggaatttgagctaaatagccttctaatgagtccgcgtgcatttccggtgtatgcgtcccaccaccatatggtgaacgaatggtaatcggcatatgccgcgtgccaccagtccggaaacgttcccgtgacatctgaccagcaattgaatccaaagtttcaaaaatgaagcccaggaattgaatttcggggattggccggaaaccttccaatgccaacccaattgataaaccgccaataccggattctgctaaaggagtgtcaaaaacacgatcttcaccaaattcggcttgcaggccatcggttgcccggaagaccccaccgtttttaccaacatcttcaccaaaaactaaggtcttttcgtctgacccgagttctaatcgaagtgcatcggtgatcgcttgaatatacgttttctttgacatgttacttcgactcctttgcttggaattccgtaatttgttgttgaatgttttgtggttgttcctcaaaaacattccccaagaattcggtcattttttgctttggtgcttcatctgcttgtttaacagcagccttgatatcttctttaacttgttcaacgtattcgttttcttgatcttctgaccaaacaccttgatcagtcaagtacttacggtaacgaatcaatggatcattatcgaaccaaggttgttcttcgtccttagtccggtaacgcttaggatcatccccagcattcgtatgcgggccaaaccggtatgtcagcgtttcaatcatgacaggaccgttgccagcagcagcgtattcccgggcggcctttgttacttcataaacagctaggaagtccatcccatcgacctgaacacttggaataccggcagcaactgctttttgagccaacgtcttcgcagctgtttgcttgcgccgtggtactgaaatggcataaccattgttttgaacaatgaagacggccggtgcttcgaaggctccggcaaagttcatcccttcatagaagtcaccttgcgaagtcccaccatcaccagtataagtgtaggcaactttgtcttcggtaccgttctttttaatccctaaagccacaccggcagcttgtacgtattgagcgccgataataatctgtggtggcattgcatggaagtcttctggatattcgttacccaagacatgaccacgagaccataggaacgctttataaacaggtaatccgtgttgaatcaattgtggaatatcacggtaagcaggcattaaaacgtcggttttcttcatcgcggcgttactacccatttcactggcttcctgaccttcagttggcgcataaaatcctaagcgcccttgccgcgtcaacgcgttggaacgttggtgtaacgtccgttcccataacattaatttaaagaattcaacgagttgttcgtttgaatatttagagacaatttctggtttaattactttagcttgaccatccaatacttgcacgggttcaaagtctttcccaagtgcatctcggatcgcaccaaaatcaacaattggtttttcgttgtccataaatgacacatccctttcatgaacgtacaaacgagtgctcagcaccgcgttcgtaatcgttttcataattacaagtctaatttaccattgcatttcaccttttgcaagcccttccaaaaggcgggaagccggctttttttgtcgaaacgattgtgaactattgaatttgtgcaaatttttgttttcatttttttcataacgggcgctactttttagttcgtccttatgataaactagatattaagtgtaaactgcgcgatcttaattttggaggtaattggaattgattaaaatgcgcgacattatccgcgaaggtaatcacacgttacgcgcggaagcaaaacaagttaaatttccgttgagtgaagctgaccagaaattagctaacgacatgatggaatacttagaaaatagccaagatccagaattggctaaaaaatacggactgcgtgccggtgttggtttggccgcaccgcaagtcgacgtttcggaacaaatggctgcggtccttgttccgagtgaaaatgaagatgatgaaccggtctttaaagacgtcatcatcaatcccgtgatcatcagccattcagttcaacccggggctttgactgagggcgaaggttgtctatccgtcgaccgcgatattgcgggctacgtcattcggcacgaccggattacgttacgctactataatatggctggcgaagagaaaaagattcgtctcaagaactacccggccatcgtttgtcagcatgaaattgaccatcttcatggcatcttattctacgaccatatcaatggtgacaatccgtttgccgctgatgatgatttagttctgatttcttaaagtcattaaaaaagcagtcctgagcaatcaggactgcttttttggtgcactcgcattcaagcgccgtaaatcttccaaatattctagagtggcttcgttcatcaaataggcaatatccaagtggagctgtccactacgcaaccacgcatccgtgacccgtagcgccgggccagcctcttgaaaagcggccacttgattgtgaattgcatacacttgcaattcgttattgaacaaccgtcgtacttccggcaaatccgctgccaccatgcctggtgcatccagtacgtattcaaaggccatcacaccacgcccccagacatccgcaactggtaccgaatggatcgcccccgcgacctcttgaatcgtcatcgcgttagcaagtactttgaacgctgctgccatcgcactgtccactgttcgttggccagcccgccgaatcttcaatgccgcgcgcttcaacacctgccgccgcagtaactcataaacgacgattgcaattagcaacccaccaatgattgttaaccaactctgcatgctcaaccctcaattctttttttgtataatgattcacaattttaggaatttttcattttattacttatgtttagcatagcatgtttcatcaaaaaaaattcttttaaccgctctatttttgaagaaagttaacattgtatacacccatcttaaattatgctaaaatgtaagataattgttgtgtttacacaacctggtgtacggatcaaacttttatttttgctatctatttagattacttagtatctaaataaatcttgtttatattaaggagttttacgcatgatttacaaagtatattaccaagaaaccaaagaacggaacccacaacgggaaacgacccaatctttgtatctcgaagctgagaccgaagtagcggcacggaccttagtggaagataatacagatcacaacatcgaatttatcgaaccgttagaaggtaacttcttggattacgaacaaaaaaatccagagtatcacctaacggagttcaataaatgaaacggttaaacgtcaaaaataacgaaaccgctgtttttgcagtcggcggtttgggagaaattgggaaaaatacctatggtatccaatttcaagatgagattattctgattgatgccggaattaaattccctgaggatgaacttctcggaattgattacgttattccagactattcttatctagttgcaaatcagcaaaaaataaaagctttagtgattacgcacggtcatgaagatcatatcggtgggattccattcctattaaaacagatcaacgtgccaatctatgccggccccctagccttagccttgattaagggtaagctagaggaacacgggttattaaaaacaactgaattacacgagatcaatgaagatacggtgctcaagttccgtaaaacccgtgtctcgttctttagaacgacccactcaattcctgatacgctgggaattgcggttcaaacaccacctggcacgattgtggagaccggggactataagttcgatctgacaccaatcaccaaccagccgccgaaccttcaaaagatggcgcatctcggtgaacgtggtgtactggctttaatgtcagacagtactaacgccgagcggccaatctggacgaagtcagagcggtgggtggcgcaatcaattcggcacattttcgaacaagttgaaggtcgaatcatttttgccaccttcgcttctaacatctcgcggattcaagaagcagctcaggttgcccttgaacatcatcgcaaaattgcggtatttggtcgcagtatggaagcagctatcgtcaacggacgtgaattaggttatctcaacatccctgacgaagcgatcgtcgacgcaaacgatttgcgctccctacccgccaataaagtcatgattctatgtactgggtctcaaggtgaaccaatggcggcgctctcgcgtatcgccaacggcacgcaccgtcagatttctattgaaccaggcgacaccgttattttctcaagttcaccaattcctggtaatacgttaagtgttaaccacgtgattaacgaactcgaagaagccggtgcaaatgtcattcatggtaaagtcaacaatattcatacatctggtcatggtggtcaggaagaacagaaactgatgttacgactgatgaagccgaagttctttatgccaattcatggtgaatatcgaatgttgaagattcacaccgaactggctgagcaatgtggcgtgccactagatcatagctttatccttgaaaatggggacgtgctcgccttcactaaggattctgcccgagttgcgggtcactttggtgctggtgatgtctacgttgatggttctggaatcggcgacattggtaacgttgtgttacgtgaccgccaagtgctttcagaagaaggtctggtagttgtcgtcgccaccatcaatttaaacaaaaaagagattcaagctggcccagatattttgtcacgtggctttgtctatatgcgggagtccggtgacttgatcaatgaagctcggcgacatgtctttcggacgatccggcgcaaaatgaagtcggacaaggcgaccgaagcaacgatccgtaatgcgattattgatgatctgcagagtttcttatttgataagactgaacggcatccaatgattctgccaatgctgattatgaactaactacttgccggaacgatcctgttccggctttttatggtgtaagactgatatgaggtgtaattttgattgctgaatactacattattattaatgaattggcaggctccggtcacggtaaggtcgtttgggaaaccgtcaaaccgattctagaacaacgccaaattcggtttgaatatcgaatttctgaatatgctggtcacacgattcgactcgcaagtgaatacgtaaaaacgattcagcgacgaccaaatgtgactccggtcattctggtcattggtggtgatggcacgctgaacgaagccctaaatggcatcatgcaagtccctcaggatgaacagattcccctcgcctacattccgggcggctcgggtaacgactttgcccgtggtttgggcatggcgactgatccagcaatcgcacttgcacaagtccttaataatatgcggccccgtctgttaaatgtgggctactttcatgagaccttgaagaacgagcaccgttactttgtcaacaacgttggcttaggctttgacgcccaaatcgttgatgacaccaaccggagtaagaagaagggccgtctgggccgttgggcttacctcagcaatatgctggctgcctattcccaacaagaagggtttccactgacggtacacgttaaccgcaagcgggactattataaacgcgcctttctttgtacggtttcaaacattccatactttggtggcggggttaaaattctaccgcaggccaatctgcatgatgatcagcttgaattgatcgttgtcgaggagccccattggtggattattctgtggttattcattttactgctaatgggtggtcgtcatctcaattcgcgcttcgttcaccattatcgcaacgctaacttacacttgttggttaactccgttgaggttgggcagatggatggtcaaattattgggaatcgtaactacgacctctacctgtccacccacccgtacccattctggatcgacactagcattcatgaccaccactaaccacctgctaaaacgacagattttagaacaaaaaagtcgctgcgaggattctcgcaacggcttttttagacgttgatatttcaaagtttcttactagcttatgccagtcgaaaactgtctgtgaccgaccacagggaccagtcgcgactcaccactcatttgaccggcagacacagcttagttgataaaaaaagactgctaaccatctcagtatggttacacagtcagtttggttattcttagtcctcagaagcgttgattgcttccagaagcatgtcaagttgttcacatttacgagataagtgactcacccgttctttcaagtgcggataaatggtcacaacccgtgagcgatcctgttgtcgaacggccagcgtctttaaatgatcgagttcggtattagcctcttgatattcttccagaatctcaaaacgattactcactgatagcacttccttatcacaatagatggtccaatttttcgaatagaaaaacgacaaacataatataccacaattattagtaagtttaaatcataaaattaaaaaaataaataaaaatccccctaacacttaagaatatcgtgttagggggatttacatttaaaatcgacttacttaaccgtacctgcaaagcttggcatgaagtaagaactgatcgtctgaacttgaacgttttggccttcagttggggcggcaacgtattggttattaccaatatagatggcatcatgataagtgccaccacgactcccccagaataaaatatctccaggttgagcatcggcaacggaatgagtcgttacataggattcctgtgccaccgtactatgtggcaaggtaatccctgctgcatgttggtaaacataggaaactaaaccagaacaatccattcctgaaagactggcaccaccccatacataaggaatgttggcactagccaacttcaatgcgaggccagtgacagaaccagtagctaaatcactcgttgagctcgtcgtggtactactactgttagtcgttgcagtactacttgcggtgctgctggcactgctagtggcggctgaagagctactctgactagtggtgtttgagctggtcgctgcagagctactttgagttgcagtactcgtgaccgcagtcgccgctgtactttgcgcttgactagcagtgctcgttgccgtcgtactgctggtactggtggcactagcagtcgacgtgctactttgactcgtcgttgaactagcagccgaagctgtgctactcgaaactgaagcgctcgatgcaacactggtcgactgactaatcgcagttgatgaactggcactacttgatgagaccgcagcactcgttgccaccgctttgaccgttgcagacgaagttgtggcggttgatgaagcagccgagaccgtcgatgatgatgcgttcgacgtactagaactactggttgagttcacactggcagcatcctgacttgctgcactggtgctacttacgacgctagcaggcgtacttgaaactgaactagcactagtactcgaggcagaactggcactaactgccgtcgtagatgcagtgctagtagctgaagtggtggtcttttgactcgtcttagcggtagccttggtcgttgctccaggcacttgaatgttttggcccacaacgattaaatcgccggaaaggccatttaacgattgaagcgcatgaacagaagtgttgtaccgatcagcaagcgcccaaagagtatcacccgctttaacggtatatgtacccttagcagcggctttcttagttgctgacttagtcgtggcggtcttagttgcagacccaccaatctgtaaattttgaccaacataaattaaatcgacattaccatcagatgctttaatctggttaagtttttcaatactctgcacggaaacaccgtgttgttgagcgaggccccaaactgtatcgtttgcttttacagtgattgaggcagcattggcagcttggcctgtagcaagcaataaaccaacggcaccaaccgtactggctaggaccttgcccgttgtatgtgcttgtgacatttaattcactccttagttttttgaaatcaagttaatcgtaacaagaacgtcttgtgactgaagattaagaaattcttaacctgcttttacaaatcataattttattgtagcacaatttactaaaatacaaactagaatcgctcgtttttttacaaaacagtacggttattttgaaaaatgtttgccactgccaaaacgacgcggtttgccgccataccagcgtttatgcatataaacggaatgttatcttttgattacctcaagtaattagttgcaccgttctgaggcgttccgccgttgagtgaaccaactaaaaagcacatcagcctgttagggggctaatgtgcttaaagtcgcggtattagatgcggggatcaaacaaccgatcaactggttgctgttcatggatgagtttaattgcatcacccaataacggcccgactgatagttgaaccagcttatcaaattgtttttctgctggaatctgaatcgtatccgttacgatgaccttctcgaacttagaagcctgtaacttggcaaccgcgtcctgtgagaagatcgcatgggtcgcacagccataaactgtcgcagcccccgcttgtgctaaagcatccgctgagacgtcaaaccgagtgcccgtgtcgatcatatcatcgatcacaattgcgacgcgtcccttcacatcaccaataatgctacttgggaccaaatcatcatcatcaggatgccgattgtcaatgatggcaattggcgctcctaataattccgccatcttacgtgcccgtgaaacaccggcatggtctggtgaaacgacgacaagattatcggtaatgccgcggtccttaaaataactggccagcaatggcgccgcaaataaatgatcaaccggaatatcaaagaacccttgaatttgtgcagcgtgtaaatcgactgtcagaacccggctggcccggtctttttccaataatgttgcaatcagttttgccgtaatcggttcacgagaacgggctttgcggtcttgacgtgagtacccgtaataaggaatgaccacgttgatctgactggcactcgcacgccttagggcatcgatcatgatcagtaattccaatatcgtatcattgactggttccgaaatggattgaatgacaaaaacttctgccccacgaatactttcttcgatgttaatctgaatttcaccatcactaaaccgctttacggaacttttaccgagtggaattccaacccgttgcgcaattttttcggctaacggtaggttcgaattcagggcaaacagtttcagtttggcataagattgatctgttgacataacgacctccataaaagttgtttgatgattttgctactttgattatatcagtaaccacggctaaaaaccgctcacaatcgaatttttttgggaatgaacgttgtcggcaatgaacagctcgccgcgattttacttgctacaaccaactaattatcaattggccacttgcgtcatgaaatcagctggtgtgacaccattcataccaatcattggatcaatctgaccagcactaagcaacgctggcgttaaaattgttggtcctgtattctggcgacgcggttcctgaacctcttcagcggccggttcttcgccagaagcaattttctcgtcatcagcgaccttcgttgcctctggttggtcaatcgtcgcagtggcgtccgactcagtggcagctggctccccgccaaagacttgttggagtcgcttggtcagcgtggtttgccgattcaccgattcattggtgacgcttcgctcaaatgattggctatcccccagcagaattaacatctgttcagcacgtgtcacggcagtatagagtagattgcgttgtagcatccgtgaaaattggggcaccagcggcaaaatcaccattttaaactgacttccttgggacttgtggattgacatactgtacgctaacgtcagtcgattccactcatttcgttggtaagtcacttcgttttgatcgaaagcgatcgtgatttggtcttttttggactcgttgtgtgagtcgtttgacaaatcgataccgacaattttaccgatatcgccattaaagacgttatcttcgggtgaattaacgaggtgcaagaccttatcaccaactcggaaatcttgaccgttatacgtcagatgcttctgtcgggcatttttcagtggattaaagattttctgaaccgtggtattcaactgatcgattccggcggtaccgcgatacattggtgctagaatttgcacatcctcagcactgaaacctttcgccttagctcgcgcgacaacctgttcaacaatgtgattgacctgataagcattacatgcgataaatgagcggtccggttgattgacggcaaaatcggccggtaaatgaccatctttaatagcgtgagccaatggaataatgctggaaccatttccttgccggtaaatcgttgttaactcaatttgtggtaattcgctaaactgcaataaatcatgaaacacctgtccagcccctactgatggtagttgatccttatcgccaacaagaatgacttgcatgtgacttggaatcgccgtcagtaactgctgaaaaagcaccgtatcaaccatcgacatttcgtcaataatcaacaagcccccgtctaattccttactaggctcctcggggccatcctcgcgacccgtcagcccaagtaaccgatgaatggtactagcgggaagtcccgtcgtttcggccatccgcttggccgcccgtccagtcggtgctgccagcagaatcggaaacggcttatccttatactgattaatatctaatgaaacgtcgtgtaattctgcataaagcgcgacaaggccacggataatcgtcgttttaccagtacccggtcccccggtcagtagaaaaacaggcgccgtaatcgcggctttgagtgcttcggtttgtgattcatcataggtaatattgctggcccggccaacatgcccgatagcccgatccacggcgtgtgccgatagtttttcatcattatcggcggctaacagccgttgtaagtgttccgcaacgcgccactctgcttcatagaggccgcgcaaatagatacgattctcgtcacccacgattttattttctttcgccaggacgactaactgatcagctagctttgaaggatcaatttgaacattgcgagcattctcaagtagctgcaaggtttgattcagcagcggctgagccgtggtatacgtatcaccgttctccacacacagctcattgatttcagtcaacaaggccgccttcaaccggtcatctgcttgaggatcgattttcagttgggccgcaatttgatctgcttttttgaacccgactcctttgatatcctcaaccagacagtacgggttctcttgaatcttagtcaaagtgtcgccttgataacgtgcatagattgcagcagctaagcgactaccaaagccgtatgcattcagcccaataatggtttgctccaaaccattattgaccgtaagcgtatcaatcaaggtcgcctgaacactagcgcgaagtccgatcggttttaaaaccttcgggtcggctaagatttgatcgatggcgtcctcacctaaagtatcaacgattcgctcggcggtccgttttcccagcccaggaaaatcgctaccggatagataggcaatcaggcccgcgcgcgtcgtcggggtttcgttttgataattatctgcttgaaactgaaccccgtatttgggatgagtcaccgttttaccggtaaaccgataagtcgtttcctcctgaatatccgcaaaatttccagtaaccacgatttcatcttccgaccaatcgatattttgttcagttactttgaccaataaaactttataaaaactatcggcactgctaaaaaaaacggcagcgactttaccgacgataaagtgtgtgaccggtccccgaccgacatcatcggaaaataaatgtgcttgttcgtccgtcacggaaatcctcctcaattagtgattttgatcatcagcttgtgcggctaacattttctcaatatccgttagctgttgctggtgggttttgaaatattgactgtccaatttctgcgcacgttcaaaccagtttgcatacggttttcccaagaccattgcggtcagtcctaggttaaaagcggctcggccagattgggggtcaatgtcgtatgcacgctggtagtaatccgatgcctgccgattattgcctaatgcaagtaatatatctgctgctaacaaattggcgtcagcttgttgtgggcgagcctcctgtgccgtaatggcccagactaaggcatgctggtaatcgtgtttcgccattaaagcttgcgcactcattaaataggcatcctgttttaatttatcatccgtaatttgttgatagtatggtaatgccttgtcataagtttgagcttgataatagacgttgcccagcgcgtaacgcagatagtcggccgcgggctgttgctgttcaaattttcccaaagccttcatggctaaagcctcggcctgttcaaaatcctgaccagccgttaatagtaccactagttcatagtaagcatgatagtcctcgggctgtgcatcgatcttgccaatcaattggtggaccaatgcttgctgttcagctttgctaggacgtgatgttttggccatctgaatcgcttccttctataattaaatcgtatctgttgcatcgggccgacgtgataaatacgacgtatcattccaatctaatagtttgaaatgctgaccgcgatcacgcgtttctaggatcgtagtggaggtattcgacaagccaccccgttgccgcaacgtcgccagtgtcgcccccagtaatgagttgaccaaggcattcaacgccgcaccatgacttacgatcaaaacattgtcatcgcgacgcggatttgcctgaacaatttgcttgatggccggggtcatccgcttgagcaactgttggaagctttccccctgaatcgcggtcgggtcatactgatccggatgatttcgaaacgcatcgaattcggccgggtactttgcttccacatccgtgaaggccatgccttccatcttgccgagattgaattcccgcaagcggctcagtaccgtcaatggtaactctgattgtgtcagatcatcacgcagcgtcattgccgtgtcacgcgcccgtttcaacggactaacgtagatgtgactaaaatgaatatcctggagtgctgccgctaattcatgaatttcttggtaactcgttggcaataatggtgaatccccttgagagccttgatagcgtccttcaagattccactccgtttttccatggcgaacaaataataattttgtcaattgcttacttccttactctagcgtcttgattctaatcttatttcccagcaagggactctcaaaaccgagtgtgagtgcagatgagcaagtatcatgtggctcatcacaatcgcggttatgtgagccctgctaatgactcaaataacgggtcgatggccgccatcgttcgtcacggccacaacgcgtcttacgttctatattatgacagttttcagactaattttcaaaatctgttcacaaattttaacgatgattacgatattattcgacacctgcggatttgacgacctactcagtgaaataaaatgagtaccgtcctaatctactcagcaaaaatataattatgtaaactgtattcaagaaaacgacaccccatctttatccaagtatcgataaccacctccgtttctgtgtcattggtatttcttccccgaaattgcgtcataaaaaagtggtaagtagctgtgaaacactacttaccaccactcgttatcatggtgttggcacaatcgccaacgtccaagtaatggtgctttgataatcaccaggtgttgccaatggcgttgccggtaactgtaatgaactcggtgccacatcaaaggttttactctgatgaccagtctgccgatagacagttgcagtcgagccatctgttgggatagtctgctgtaacacccccgtcgtgtctttgagcattagccgagccgtcttgatcgttgcatcccccgcagtgaacggactcaaactcgccattaattgccagtcggccccaacagtccgatcgtcaatcacggccaaccgataatcgttgttaccgtcgtagccgtcattagctttgatggcggtcgcatccgttgccaaatcggttccttgcgcgagtcgttgcaaggttagcgttccaaaatcaaaatttgggaccgcactcagtgacaagtgcccgccacttgtaaccgttaacaaagcggcgttagtcgtcaccgtctgtggcttaccattgaccggataactcagactcgcatagtaagccgtgccatcatcatccgcattagtgggcaccctgagcgtataactcgtatccttgatattcagcgctgtcgctttaccattcttgacgcggtaccaattgctgacagtcacaccctcaggcaacgttggtaaggtaaacgttgcgggtgttccttcgacaaccgtcacatcttgtaacgccccaatcaaaatcttgacgctatcgctcagaccattggaagtcccggtaatcgtgaccgtcccgtgatcatccgctttgccagaattatcggtcgcggcgtctgtggcagtcacattcccatattcatcaacggccgctaacgacgggtcactgcttttccaagtaattggatccgtggcgtcttcaggcgtcagtgtcgcgtgtaccatggtcgcttgtgcattattaagccacgcgtcatcgcttgtcactttgatgccagtcgttactacccgggcgggcgtgaccgtcactttcgcaattttggaccagtaatcggggaacgccccaaccccggagaaatcatactgcacctgaaaataaagatgcgttgttttggacacttgtggcgcagtgaaagtgtatgttcgactattagtgccaaccttctgataagtttgaccctcgtccgttgattcccaccatacatacttgcggccactcaacagactagtcgccgcctcaagcgcacttcgctgggcccggaccgacaacgtcactgaattaccaccaatcacattggaatcgatgggctgttgtgaaaaaccacccgatagattcaaacctaggatggaactcggcggactgcttggcgactggggtgccgttttggccgctaaggtactcgtggcaacgcccaacccaaccagcagactgagtaccatcaagcagcaagtcttaactaactttctcatcgttcctcactccttacgcgaacgccgctggccaaaccagtacgccgccattagaagtgccaggagaacgactagcaccacagcaccccacagccaccagttgaccttccgtggcccaaccaaatgatgattatgttgttgggcccgttctgcagtcaaggtaaagtcacgggtgaaattccagacacgttggccactcgtcagatgcaattttagtcggtactttcccgcggctaaattttgcgtacccaacgcaatctgataattaaaccagctgttcggtgccattgatcctgatttaagctgctgcgtggcaacggtttttcccgtcgcgcgttgaataacgcgtgcttgaattttgagttgtccaaaaagtgtcggcgtcagattacggagcttggcaaagagtactggttgcccgttagtgggcgtcaccttaacctcatcgagggctaacttaactgggatcgtcacttgcggctgacaccaaagcgccaccgcggtaacttcggcatagcggttcttcaacataaaaccttgactcgtcgttggtctggccgcattagcggttggattggtgacaaagaggccacctagcacctccccttggaagccagacttgggaatcgtggtcttaaaagccaccgttttcgcttgatgagccgctaacttgactacgacgccacttgacgtcatgtcagtaaacgtcgtcgtggcagatggatcatgccgcttagacggcacgtacgcgacgctgcctgcatctgaggtcgttgcgttgaccggtgttacctgcaacgtaattgctgatttaccaggattgctgacggagactctgaacgttgacgtcgttcccggcgtgaccttcatattaaagtaacccgcctgcttatctagttgatccttgggcagtaggggtgtcagaataaaacccgatgcgggtgtgttagacgccgcgtgaccaggtaatgaccctaaaagcccgcctagtagcaatgccaacactaataaccaccactgaccgatttgtttccatcgcattctaaacacccccacttcacttaatcattgactagcgacgcgtgacgaccggttgaacctatgaagctgcttttggtgttgctgccgccgctgctggcgcattttgtagcgtccagtagagcgttgccgtgtacgttccagcagagatattagactgtttaccgacttgtaacgaactgctggtcgcggtcgtcgctgagttggatccttcaccggtatctgcagcggcattccataacgtttgcgggcttgtgacccacccgttggtcacttcactttgattcaaacttaacgcggttggtgccgcagtattcgcattatcagcggcacccttagtcatattcagattcaacgtggcggagtcgactttggctgcgcctgcgctgaacgggcccatcccaactgtcaatgtccagccagcatgattcccccgaaagtcactgacgtttaaggtcccactaccattgccatcatagccgttgccgcctgacgtgttactacttgtcgcatttaacgttgtagcggtcgatgcaatgtttttgacgttcgtcgaacctaacgcaatatttggtacggcatccaacgttaattcaccaggcatgaccgtaaattgggcattcgataacgcttccgcattgcccgtactatccgcaacataaccagacgaaactgtcgtcaaattgttgcttgctgttccgggtccggccgctaatgccgctaagggcattagtgccagtgatagtaaagtcacgccaccacttaacccggtcattaatttaaaagttcgcatgttgcttcctccttctcaatcgactgcttttccagtcgcctgctaccatattagtttactaatcactttatgattccgctttcaccgtcctcttcccctgacgccaaccatagtttagcatgtataccaatcgaaactgcgggctatgttttgattcattaactttccatattaattagacgcccgacaccaaccagccaaatgaggggctaccaacaactattggcgcacaaaaaaacatcaaggcccgttttccttgatgtttttgcataattaattcatttatttttttaacgcctcatccagcgcaatgacacccttgactggaccaactacggtaatcacatcatggagcgccatcatatccgtcggcttgggtgaaacgtcaatgtgcttatcgtgtttgattgcaattacagtcaggccaaaccgctgtcggatctttaaatcgatcagattctgattaacaaagttcggatccgtgatttcaattgcggccaacgtatactcatcacttaagtcaataaagttcaaaatatggttggaaaggatgcggtgggcaatgccctgacccatatcacgttctggaaagacgacttggtcagcgccgacccgctccaggacccgcccctgatcactggtttcagctttggcgataacttttttagccccctgctccttactcaacattgtggtcaggatgctggcttccatattattgccgataccaataatcacgtagtcaaacgtatcgacgttcaggtcacgcagcacttgctcatcgcgagtgtcagcaatcattgtctgtgtggcgacgtccatcagctcgttaactggttcttctttaatatcaacggccaagacatcctgatgagcggcggcaagcgcccgaacgacactctcaccaaaccgtcctagaccaaatactgcaaaactttttcgcatgttccccacctaaccaatcaaaatattttctgccgggtaacgaatcaaattaaccctagcctgacgtctggacagcgcgtaaagtgatgtaaaaatgccgacccgaccaataaacattaacatcatgatgacaatcttcccaattaaagtcaggttgggtgtcaatcccaagctgagtccaacggtcccaaatgctgataacacttcaaacaaaacgtattccaagccgaaccccttcggaattttttcggtctgcgtcaaaatcagcgttgctaccgttaacacaatgctggccaagaaaatcagcattaacgcccgattgatattctcctgactaaaacgacggtgactgaactcaacatcacggcgaccacgaagctgggcaatgctttggaacatcaagacgccaaacgtcgtcgtcttgatcccaccagcagtcgatcccggcgtcccaccgacaaacatcagaatcataatgaccaataaactccccgcctgcaacccttgcgtgggcatcgtgattaaaccagcggttcggggcgtgacactcaaaaacagcgtattgatcgtgcggttgacccatgacatcccatttgggagtagcgctaagtcccgctcagtaatcaacaacaagacaaaaccgatgacaaataaactgaaggttgtcaggagtgtcagcttggaatttaatgtcagtcgtttgcgcgtgtggtacaacagcacgtcccgccaaactaggaacccgagaccacccgcaataattaggaccattgtgaccgtcaggacgtacggatcatcacgaaaaccttgcagactatcgccaaacacatcaaaaccggcattacaaaatgacatgaccgcatgatacagagaaacgtacagtccgtgacgccagccaaatcgaggcacaaaatcgactgccagcaacccgaaaccacctagctggaagagcagtgacaaaccaacgacatacttcatgacacttttggtatcactcaatcgttctaggtttaaagacgctttgaccatcaactgcgtggagagaccaatttgacgacgcataatattaaagagcagtaccgcaaaagtcatgtagcccaacgcaccgacttccgaaagtacaagaatcaccaactgcccaaacgtcgtccagtgcgcggccgtattgacgacggtcaagccagtgatgcacgttgctgaagccgacgtaaacagcacatcgatcaacgatgtgtgtacatttgccggtgtcgcccatggaagactcagcaagaccgtcccaatcagaattaatacaataaacccggctaccattttcttagatagcgtatcaaaaagtctaaaatgtgctaattttttcattatcattccatcccgcaacaacttattgatttcaaccaatccgtccgattgatcacactccatttagcttaatcaacctaggcgagaaaagcaagtcccactccgctttgacgtgcaccagcaacggccgctccgatttgtcccacaataaaaaccgctgatcaagccaagctgatcagcggtcaatcaattataaactaaacatactgcaagacgcgctcatcattataagccgcgtcaatcatgccggaacctaagcattcctcaccgttgtagaaaacaacggcttgtccaggagtaatcgcccgaactggatcgtcaaaagttacggtaacttccgtgtggtcatcattaaaatgcaccgtcacaccggaatctttttgccggtaacggaacttcgccgtcacgtggaagtcattacctaagtcttcatcagtcacaaagtgtaagtcggacgcctttaagtgggtcgcgtacaggtgcggattatggtaacccttgccaacatacagaatattcttcttcagatctttgccgacaacgaaccatggctcgttgtcctcaccatcaccaccaataccaagtccgcggcgctggccgatcgtgtaatacatcagcccggcgtgctcacccttcacctgaccatcgaaagtcatcatcttaccgggcgttgctggtaagtaatggcctaggaattccttgaagttcttttcgccaatgaagcagatcccaacggagtccttcttcttagcagttgctaagcccgcgtttaaagcaagcttacgaacatcaggcttcaccatttcgccgagtgggaacatcaccttttgtaaggtctttgaatccagctgactcaagaaataagtttggtccttgttactgtcaacgccacgcaagaggtgcatcgtgccatcttcatcatgctgtaaccgcgcatagtgaccagtagcaatgtagtccgcccctaaatccatcgcgtaatctagaaacgccttaaacttaatttctttgttgcagataacgtcggggttcggtgtgcggcccttcttgtattcgtctaagaagtacgtgaagacccggtcccaatattccttctcgaagttaatcgagtaataaggaatcccaatcttatccgccactttggcaacgtctttataatcttcggtcgcggtacagacaccattttcgtccgtatcgtcccagttcttcataaacacgcccaccacgtcgtaaccttgctgcttcaagagcaacgccaccacggatgaatcaacaccaccactcatgccgacaacgacacgcgtgttactgtgatcagtcatacttttcaccatcatttccaaaagattctggagaatccacgatttgaaggtcgtacaagtccagtaagttccattataacaaagaaaacgccggctgcaagccaggcgttccctgattagtccgtcgtgaggacatcgcgttcaataaagttagctaaaatataccgtaattgttcaacggcctccggatgggcgtcatttttgaagatatttgcccgttggacaccattgcccgttaccgtcgtcatcttaaacccagtcaagtccgcgttaactgtcatcttcagcttaaaagctgcttgataaggtgaagtgggatccaaggaacgttcaaaactaaacgcgcccgagcgacccttcacaaaacccaaatccatcaacgtgtatttcttgaccgttggactcagcgtatacgtcttagtatccccatctagtttaaccgttgttgtgtatgccatcgtcacgccccctgcttttttaataagcgctgcgtcgtcttcgtcagcaccgtaacaaactgatccagatccgctttcgtcgtatagcggccaaaactcaaccgaatcgactcactgatccgaggtgagtcttcgccaaacattgcaattaaaacgtgtgatggttctaggctccccgccgtacatgcagagcccccagatactgcaacaccacctaagtccaggttagtttgcattgtataggtcgatacccatttgatccataagttcaaaacgtgttgcaagttatgctcaccgagtgacccgttgacttcaaaatcaactccgttagccgttaactggtcaacgatgtattgcttgaactcacgatacttagcctgccggtgggccttctcagcggtcgtcagttcttgcacggccgtggcaaagcccgcgattgccgggatgttctcagtaccggcacggcgcttatcttcctgttcgccacccttgacaaagctagggaagttaatgccattgcgtttatacaagaagcccaagaatttaggcccattgattttatgtgctgaggtggacaacatatcaatatgatcccgttgcacatcaatatccaacaacccgtaggcctgcactgcatccgtatggaaccatgcctggtgatcctttaacaattcaccaatttcatggattggcatctgtgaaccaacttcattattcccggtcatgattgagacgagaatcgtatcaggacgtagtgccgccttcaaatcatccagactaatttgtccctgttcattcacgggtaaataagtaatctcaaacccatgttctgccaaaaaagcagtcgatttaagaattgcttgatgttcgattgccgtcgtaataatatgcttgcctaaatgttggcgcgtccacgcggtctgcatcaccgccgtattatcactttctgtaccaccactggtaaagataatgtcatcgtcagctgcgttaatgctttgggcaatcacgtgccgactatcgtctaaaacttcacgggcggcccgaccgaatgcgtgggtgcttgaggcattgccaaacgtattcgtcatttgatccgtcatcgtctgaataacggacgctgccattggggtcgttgccgcattgtctaggtacacttgcttcattacatcatacttccttctaaataattcttagttattagcatcgctgcgatacatctgactaattttgcgccgcaaataatgcaagtaacatcgctgcggactgcttacccgcttccaggataaattcgtcaaaactaacaccggcattttcatcaccgacatcggacatcgcgcgaatcaccacatatggcgtctggaactggtgacaagcttgaccaattgcggcgccctccatttcactagatagtgcttctggaaagtgtgctaaaatcttatcggtagctgccttaccagcgataaattgatcaccagacacaattagtccggtcttggcattcaaaccagtggccttggccgccgccatgatttgctttacccagttggcatccgtttcgtagtatagcggctgttgtggtaattggccatattcgtagtcaaaggccgtcgcatcaacatcgtgataagcagttgccttagctacgaccacgtcaccgacatgcaaaccagcgccgattccacctgcagaaccagagttgatgacaacgtccacatcaaagttagtaatcattaaagccgtagtcataccagcttgcactttaccaatacccgattgcactaagacaacttcctgctgatcaattgtcccatcatagaacgtcatatccttaatattaacgatcttttcgtcttgcaaagcgtcccgtaacgttttaagttcttcttccatcgcacaaataattccaaatttcatgtgagcctagcgcctactttctatggtgttaaaaataaaattaaaaagacaataataatcccaacgactagtccagcaatcgcccaattcaatttgcgggctagccgtttcgtcttggcttcttcaacagcccggttgttctcagcagcatacgcttgtctggatgcactgggttcggccgttggtgattcttgttcctgagtatcgtgaccagttggctggctacgttgttgtcgatattgctgtctggtgagtcgatcatcatctgccactatgcttcaactcctaactcagggtgactttgccagtaccaaatcgccattacggttttggcatcctgaatctgaccagtctgaacttgactgacagccgtcgcgaggtccagcttgatgagcctaatttgttcgtcagggtcttgtgggaatgccgttgcaaccgcactcagaccggtagcaacgtacaacttcattagttcgtccgtaaacccgggtgacgtgtagaattgggcgactgcttctaagtgctgagctgtcaatcgtgtttcctcatttaattcgcggacggccgcctggtccatggtctcaccgggttcgaccttaccagctggaatctcgacggtcagcccaccggttgcagcgcgccactgttgttcaacaatcattttatgttgcgcggtaatcatcagcatcgcgacggccggctggtgtcgcacaatttcacgtgttgccgtcgtttgatctggtaaggtgacttcctgtcgttcgacctgtaccaacccaccttgataaaccaactgacgactctgaacccgttcctcaaatgtcattgatcaagaacccctttcagtgtctgctctctcaataaggataccgattttttagctcgattgcaattttcaaccgggcgattacggtaattttaacgaacccgcaaaaaatgggttaacgagcgaccaatttggctccttaacccatttttccaattcttaaaatcaagcggaccgattgacactagttgccattaagccttggcgaggttagcgacgaaatcttcataagcatcctgctcaccagtttccgttgcggtagctgggctgtagtcgccctgaagcgcatcttctaatggcaaagtcacgatccggacgaacgtcgcgttaccgatcaattccatccagtattcttcatcggcaccttggtgaacaacggttttgaccatcccaccaggattggtgacgtggatttcttgattaaaatcggtactttcttggtgtaataacacgtacatcaatgaggaagcagacatcgccgtcccacaagcattggtaaaaccaaccccgcgttcaaacgtgcgtacaaaaattgaatttggtcctaagacttccacaaaactaacgttgacgccatcagggaaaatttggtttttaccatcattcatccattcaccgatacgtcctaattcggggccaaccaacgtatcatggtcaacgaacgcaatcaaatgcggattaggcaccgccaccgctgagaatttcaagtcagcagacagcgctggaatcttttcattaataattgtcgtcgcatcgttattcgcatgcatgccaagtgtctgcgcgtcgaaagttacgggcgaaatttcaacactgtaagctgggacgtgggccgcaaaatcagcaacggcctgcacctttaagtccgcatacattgtctgaacccggaagtcttcctgactattttgcgtgcccaaataacgagcaacggtccgtagcccattaccgcacatgctagcttccgtcccgtccgcattaatgacccgcatccgaccaagtacttgtggatgttctgatttatcaacaaccaacacgccatcagcgccatcgtacaaacctgcgccgtcacgtttacaaatgttaattgccaattgcttcaaatccgcatccgataacggtgcttgaaattgtgtttgatccaataaataaaaatcgttaccagaaccgtgtaccttgatcattttcacagccatcaacatcctatctatataaaatcgaccttaatttaaactacttcattatcatactgactttttcatgaaaattcaattgcaaaggaccatttctcataataaccattcaaagtcctgcgcaacaactgtatgttctcaataactattaaagattgcctccaaaatactgagtcaaaaaataacaccgctttttggcccgttgccgccctgatcatccagcattaaagtctgctgcccaatccagaagcctggctatcagcaaaaaaagtgccaccaatcagtcccgttcgactgattagtggcacttttcataagttatcaagactcacgctaaatttaattcagattaagcttccaaaccagttgttactgattcagggtagttttcacgaacgattgcggcgcaccgtgcacataacatcggataagcctcgtcactgccaacatcggtcttaaccattcggcaacgatcacaaacgtcaccgtcagcatggccgaccttgatggctaacgtgtcaccaaatgtttctgcgtcttcaggcgcgtcacttaacgcgtgtagatctaatgctgaaaccatcaacatctgccgaacattagtgttcagatgatctaagaaggcttgcgtatcatcatcaacatacaaatccaagtgtgcttccaaggatttaccaatcaacttagcatcccgggcttcttccaacgcctttaagacgttactccgaagatccatgaaccgcgtccattgagccatcaactcgtcgctgttcgcataattttgaacagctggcatctcagctaattgcgcaaattcttctggttccttcaagaatggccaaatttcttcagtcgtgtgtggcagcattggtgtgaagagcttcgtcaaggcaaccaaaacatcgtagaagaccgtttgcatcgaccgccgtgaatggctatcctcggcatcaatgtacataatatccttggcaatatcgagatagaagtttgataaatcaaccgtcaagaagttgatcaacttcttgtagatatccaagaaatcataatgatcgtaatggtccttcgtctcagctacgaattcgttcaaccgtgtttccatgtactggtccacacttgctaaatcttcataagccacgcggttggtcttcggatcaaagtctgcggtgttgcctaacatgaagcgtaccgtattccggaacttcttgtaggaatcggctacttgcttaaagctttccattgagacccgaacgtcggaactggtatccactgaagcgacccacatccgaacgatttcagcacccatctgcttgataacatcagctggcgcaatcgtgttgcccagtgacttactcatcttacgaccttgattatccaacgtgaagccttgtgacaagacttgcttgtatggggcatgtccagaaacagccacactcgtgatcaagctagagttgaaccaaccacgatattggtcagaaccttcgaggtataggtcggctggatagtcgaggtatggacgttcggctaggacaccttggtgtgatgaaccagagtcgaaccaaacatccataatatcggtttccttagtgaaggtaccgtttggtgaatgttcgttggtatagccatctggtaagaggtccttggcgtcacgttcgaaccaaacattcgaaccatacttgccaaataaatcagctacgtgattgacggtttcttcgtccatgatggcagtgccatcttcagcatagaagattggaagtggcacgccccaaacacgttgccgtgaaatgacccagtcaccacggtcacgaatcatgttgtaaagacgctttttaccccactctgggaagaattcaacgtcatccattgacttaaggatctcatcacgcatatcaccaacggaagcaaaccactgtggcgttgcccggaagatgattggcttcttagtccgccagtcaaatggatagctgtgttcgtatggcatgtatttcagcaataacccggcagcctttaacttatccagtgcaatcttgttagcgtcatcgtaaaagacgcctgcaaaatcttcgccagcttctgccgttaagacccctttgttatcaacgggggcaaagattggcaagtcgtattgtttaccaatccggtagtcatcttccccataaccaggcgcagtatgcactagcccagtcccggaatcaagcgtgacaaaatcacctagcatcgtcactaattgacgactactgtcaaaaggatgttcgcataaaacgttttcgagttccgcacccttgaccgttttaagcacttgaacgtcttcccaaccgaaccgttcggcattttcgtccaataattcggccgcgagcacaaacttacggctttcgccagccggttgcaccacgacatagtcaaaacttgcatcgatggtgattccttctgaagctggaatcgtccaaggggtcgtcgtccaaacaaccatgtaagtatcatcatctaagacacccttaccatcaatgacgtgttcaccgtagaaggcggatggcgacgtcacatcatggtattctacttcagcttctgccaaagccgattcagacgaccatgaccagaagacgggcttttggccccggtagatcaggtgacgcttagcaaacgcaccaaagacgcgcacttgagccgcttcaaattctggctttaacgtcaagtatgggttgtcccattcaccagcaacacctaagcgcttaaactcatcacgttgacgatcgacttgttctaacgcgtatttgcgacagagttcacggaattcattgtccgtcatcttcttacgatcgtaaccggcttgctttaacttctgttcgattggtagcccatgggtatcccaaccaggaacgtaaggtgcccggaaaccattcatcgacttgtaacggacgatgaaatccttcgtaatcttatttaaggcgtgtcccatgtggatgtcaccattcgcgtatggtgggccatcgtgtaagataaagcttggcttaccttcattcaatttttgccgttgttcgtagactttattttcagcccacacattttgccgttcaacttctttgaccggtaagtttccacgcatcttaaacttggtcttaccgaggtttaacgtttctttaacgcgcatattctcactccttaaaattttttatcaaacaatcgtcattgaatttttagacacaaaaaaacttcgtccacccagggacgaagttatcgtggtaccacccaattttagaattgtttaaattctctcttagcatggttaacgtccatggaccggccacccttactccattcagggtgacgttcggagatgatctgcgactatctaagggacgaccgcctttccattaccggcagctctctgggcgtattagttaatcgtttactgttctcctcaatacattcaattcgcttcaattgtaccccgtgatgacctaactaattattagcgttgtcatcatcagggaagataaccaccgtctgttgttggacttgatcgccaccgtccgcaacgggggtctcaccactcgttgcttccgtaatttcaacggttgcttctgagtttacgctcgcatcacccgagttgtcaaggctatcttcctttaaaacgtgttgaatttcggcataatcagccgtattcgtttcgctaagtagttgatcccaatccttgctcttaaccacttctaactgcgattctaacatcacttgcaaacgttgacggaaaacccgtgtttgtttcttcaagtcatcagtttcgacagataatcgtttggctttttgggaggcttcgtcaatcatttggttcgacttgtcggttgcttcgctcacaatgtcagacgcttgtttctgagcttcacgagtgataatgtcggcttccttcttagagttcgtcttcactttatcggccgcttcttgagcgactaagatagattgattcaaggaatctttcaattcattgaagtacttcaatttaccttcactcgagtcaagccgttcttggaggtctttattttgtttcaaggtaatttgataatctttaataatttgttctagaaaatcattaacctcgtcaatattgtaaccacgcagtttcgttgaaaactctttgttatgaatgtcatctggacttaacaccattagaattcctccaatatctatttactatgaataatatttaacgttattcgcagccgcgctttcttggtctcaccgctaatttcggcaagtcggacacgaccgtaatggttcacactcagcatatctaacaatgctagctcgtaatcagctttcggcaagtcagcccaattcagccgaaccttagcaccttcgatcaatttcttggcgtgatgccgcgacaagttgaacgccgctttaatgatactatccgcacgtagtgaactgaccgtcgtggtgacagcctcccagtcgtcttccggtgtaatcaccgctgacaacggtaccactgttaagtggactttcgtcttaccaaaacgatcgatctgctcctcaaaatagctggccatttcagtttcgcaaacaaattgccatgccgttccatcggtcacgatatcaccaaagacatcgcgctcaacaccagcattggcaagcgtaccgagaatttgaccgtgctttaaggtcgcaaacttcatgggataaacaatgttaaacagtgtgatttgaaaatcggcggcctcgggttcgtaatacaccgggtaaaataagatccgttgtaactcagcaccttcaaagccaccggatgcccgcatccgcacatcgtctaactggttgaccagcgtttgcgcaatgtagatttgtcgcgggttcaaaaacgcagttaagattggtcggtactgatcagctacttgtcgcagccacccagtaacctgttcaataaatggggcttcactatcgcgaaaatgttgttttaagttatcattcacgatactatcctcgttattttaatttagtatatcaataaagttatcagataaaataggccactttcagctaattggagcactaacagcgcaatgatcggcgaaaaatccagtccggcaattgcgggaataaagcgccgaaaaacactgagaaatggttcacagatttgacctaagaattggcccacgcgagtattataagctcccgggaaccatgacatcaaaatgtaaaccacaatggctaattggtacagttgaaacaaccgactaataatcgtcactaacaggccactcactccttataatttgctcgtatcaaactgacttgtcgtacttccggaaacctcgtaattttcaggaatacagaggaaaatttcatcaccgatccgttcgatctcaccattgatggcaaaaaccgtcccggtcaaaaaatccacaatccggcgtgccatttcatcatcgacgtgatcaaaattaatgattacagcttgatttttcaataactgcgtcgcaatttctttcacatccgaataaattttcggttcgaatagggcaattttgctattcaccgacttgcccccttgcattggcaccaccttgggcgtgctccgagtattggctgctgattcagtgggggccgccgcttgggaagcttcggtgggttcctcatactgactgtcagaatcaccaacaccaaaaaagttactaatgaatccggccatatgcttgcgctcccttcaccgttttacttacgccggcgcttgaagaatggtggtgtatctagcgaatcaccgctgttatcatccttactatcgtcagcttgtgagttatcattgaagacatcaaaatcagttttttccacgttgttaaattcttgaccattgttgactggccgtgaattgttcggttcgcgccgaatatcccaattaccgaatgggtcgttagcttgagattcgctcgattgggccgcttcactcgtcgctggctggtcagttgaggttgcaaacatgccgccccgttgctgactagcttcgctacgactaggctggctatccatcttgagttcgcgttgcttctggtcgataccagtggcaattacggtaacccggacttcatccccaagactctcatcgatcgaagtcccaaagatgatgttgacatccgtcgtcgccgcttgggaaacaatgtcagaagcagcttgggcttcatacaaggacatatcagggccacccgtgatgttcagcaagacttgttcggcaccatcgattgaaacttccagtaatggtgaagagatggcttgcttagttgcgtccgccgtccggttttcaccactagcagagccgatacccatcaaagcggaaccttggttttgcatcaccgtcttaacgtcggcaaagtccaagttaacgtaccctggtgatgtgatcaaatcagagataccttgaaccccttgacgtaacacgttatcagcttcttggaaggcttccatcattggggtcttcttatcaacgatttcaagcaagcggttattggcgataatgatcaacgtatcaacgttgtccttcatctgtgcaattccttctgcagcattgcgagcacgcttagggccttcaaatgtgaatggtcgcgtgacgacccccacagtcaacgcaccggaatccttggcgattttagccacgactggggccgcaccgttaccagtaccgccacccatgccggccgttacaaagaccatgtctgaaccttgtaatgcttccgtcaaggcttcttcactttcctgagcggccttggaaccaacatcaggattagaacctgcgcctaatccccgcgtaagctttggtccaagttgaattttagtttcggcatttgaagtttgtaatgcctgcacatcagtgttggcaacgatgaattcgacgcctttaacatcttcagcaatcatccggttaacggcgttaccaccaccgccaccgacaccaatgactttaatattagcccctgagttctgggttgaatctaaagaaaattccatgttttttcctccgtcatttctatccgatattaatcaaagaagtggttgaagaagcctttgacccgttcaacagttcctttatgatttggatcagcctgttcctgcgtttcctgtggtgcagactgtttcttagttgtttttttaggttgtgatgcgggttggctgggtgctggtgttgcctcagcaaattccaacgccacactggcacgtgtatcaccggtgagcgcgctcttaacgagtaacgtcacttcactcaaggccgcttgatatttgatgaccgctaacgcctcatcaaacgacggatgcctcaagcccatttgattaggcgtaaagacgcgaactcgcgttccaaaacgttgcgccgccaaatcagtgataccgggtaatgctgccaccccaccagttaaaacaatgccaccggggagctcgagcgcccgaatctcatccaagtgctgcttgaccttatcaaagatctggtctagacgagcctcaatgatttctgctaagtattgctcacttatttgctccggtgtactttgcccaacaacatcaactgggaaaagttcatcatccgaggcctgctgagcatcggcatagccgtaatcacgttttaacttttcggcattctcaatcgacgtattcaaaacgaccgagatatccttagtaatatactggccgccttcttggtcaacgtaagtatatttcaattggtgatcatgaatgaccgccgcagtcgtttgaccgccgcccatgtcgattatgatcgaaccaaaatcttgttcaccgtcatttagcactaacgaacttaatgccaaaggggcaatcacaatctgttcaatttgcagtccggctttttccagcgccttccgcgtattatgaatgattgttttcggcccagtgaacagggtaccgtgcatttcaagccggaccccgaccatgccacgtgggtccttgatgccatcaaaaccgtcgacgacaaattcgtcagggatcacatcaagcacttctcgttctggcggtaaactctgaactaacgctgccgccgcaacgttttgaacatcttcattgttaatttctttggactcatctgccacggcaatcatgccccgacagcgttcaattttaaccaggttagcggggactcccgcaatcaccttttttatttcgatacttgctttttcttcagcttggcgtactgctgatcgaatcgtttcggccgccttatcaatatcgacgatcacaccacgacttaaaccattagaacgtgcgcttcccacaccaataacgttcatttgccctttaacacgttcagcaacaatgacttttattgaggtggtccctatatcaagtccgacataaattcctgaattatccataatagaggaacctcctagtattttacataaatattcaaggattcgctgacatatccagttaatccctagtttaccatatcctaagcgcttttaaaaaggtcacacttagcattctatcaattattctgattcttgaacggataggagtatgcgcccacctcaagattaataacacccttggctttcatcttcgccgcaatccctggatagtaagtcatcttactagcaaacgtactgattgttgcgtacacttcattgccgtcattcatatacagatggacccgttcgggattagccttgttcggtgaaaatttgatttcagaaatattgtgtttgaccgccgatggtaacttcgcatactgtgcaatcatcgttgctaagcggcgaccgcttttaaagttggcatagatcggtgaaccaccaccgggttgagaataggtttctttcaaaatcagcccattttccaggatgcgccgatagtgttggccggtcgataagtaacccgcaatgcgaatctctttcactgtcacccggacaccattgagccctactaacttggtcgtgaccttgccaatctgcggctgagtatgttcagcgcgcttcgtcgtccgttgatcgtgaccaatcacggaccataaagcaactccgggattgatcttggtcgccgtcttgacctgcgtggcggataattgatcattaccatacacggtcactgtctgaacatggctcagtggtgaaatgaaataaccggccactccggcaccaagtagaaaacagcccattagtatcaggacccgtttaaaaagtaagcggcgccgctgggacttaagcttcggtagtttatcaccaattcgaagccgcttaccagaccaactgtggtgacttttttgcgctgcgcgatggttctcagccgaatcgcgttggaatcgctcccagggtgttagctgctcggggtgttcacgatccttggactttttatgaaaaatggccatcacacccaccctttcactctagtctgcgtgctacttgatcaccgattctaaaacgtgtaataactggtcagctgcgtcgggcatccctagtttcttcgcgttagccgccatcgtttcgcgatgcgtgctactttggagcagaccatctaaggcagccactaagctagttcctgttaggtcggcttccttaatcagttcagccgctcccgcattcacgagactttgtgcattcttagtctgatgatcattcgtcacgtatgggctcggcactagaattgaaggaattcctaaagcggtaatttccgcaatactagttgcgcccgcacgaccaagaataaccgcgacctctggtaagattgcaggcatatttttaatgtacggttcgattttaacattcggagcgagcgctgtcgccgacaagccattttgaatcttttcgtagtgcacttggccggtgacgaacaacgtctgataatcgcgtttgttcagttcaggaattgccgcgactgctgccgcattaatgcgcgcagcaccccgacttcccccaaaaatcaacgccgttggaatatcaggatcgaggtcgaactgcgccaaagcgccactttttttaatgttagccacttgctgtgcgcgaggatttccagtcatcacaactttttgtgcgggaaattgcgaccgcgcactttcaaatgaaatggcgattttatccacaaaccgacttaaaaatttgttggtgaccccaacaactgaattttgttcatgaatgaccgttggaatgtgcatctggctcgccgcaaaaacgaccgccccgctcacgtagccaccagttccgaccacgacatctggtttgaacgccttaatgtacttccgcgccgtaaccacgctctttaaaaacaaatagacggttttaacgttttgtaatgacaacgaacgcttaaaaccctggatcttgatcgttttaaaatcgatcccacgttctggcacaatgcggctctctagtccacgatgcgttcccacaaactgaacttgcgcttcaggatcatgtgcctttaaggcatcgatgagtgccagtgcgggatagatgtgcccgcctgtcccaccgccagaaatcattaatcgcattagttttcttccgcctttccagttaactgttcgattgctttaataaatcggtcgccccgcacttcgaagttcgggtactgatcccaactggcacaagccggcgataacatgatgatgtcaccagcctgactatgttgccaagcaattggcacagcagtctcacagttgtccgtaaactcaatatcttgaataccagctaaccgcccagcgtccgccattttttcagcagtctcaccgaagacgattaacgtcttgacatgcgcctttaatgcgggagcaagcttttcaaacgtgttaccacggtccaaaccaccagcaagtaaaatgaccggctgatcaaagcccttcaaagccatctcggtcgaaaccaggttggttgccttggaatcattgtaaaactgccgatcctcatacgtctcgacgtattgggtccggtgtcgaacccccgtaaacgtcttcaagacttgaacgattcctacagttgggacggcttgaagtttggcaacggcaatcgctgctaacgcattttccacattatgatcaccagggatccggatatcggcagcatccataatgtattcatccttgaagtaaagctttccagcttcttcataggcgccatccttggtattagcctgccgtgagaatgggacgacggttgcttgtgattgcttactgagttgccgccattcttcactatcccaattaatgactaaataatcatcagccgtttggttcatggtaatccgcatcttcgccttgacatagttctcacgtgagccatggtaatccaaatgcgtcgaataaatattcgtaatgactgcaatatgggggtgcaaagtccgaataccacacaacatgaaactcgaaagttcagtcaccatcgtatcagctgccgtcgccttttgtgcaatcgctgaggcgggcacaccaatgttaccagcaacgtaggccttaccagcattggtgcgttgattgagcatcatcgtgatcatcgtcgtcgtcgtggtctttccgttcgtccccgttacaccaatcagctcacctgctaagatttgtgaagcaagttcgacttcggtgataactggaattcccttttcctgagccccgctcacaattggattggaatacggaataccgggattcttgacaacaactttaaaatcctcatctagtagtgacaaggggtgaccacccgtgataactttgatcccgtcgctcaacaattcctgcgcatccgggttctcatcaaatttctttttgtcattaacggtcacaaacgcacctaatttgtggagcaaccgtgcggcattgaccccgctctttgctaacccaagaaccaataccttttggttacgatactgctcaaccgacttcataaaccaagatctccctataatgtttgtagatgttacttaaattgacgtgttatgtggccgatgagccaacccgtggtcatcagcaaattattcatgatgagtcagtgaccggttccacgacataatctgcggtaggcaacgcaaccattaagaaataatcgtggcgttgataggaatcggcactattcagttgtgaccaccagtggataaagtcataccgcaaaaaacaattatgtaccgctcacgcgggcaacaatgcctgtgtgagcaaaatcagaactaaataatcgtggcaacactaatgacagctgccactaaaccaatcgaccaaaagacgatatcgatcttccattcgctccaacccttcatctcaaagtgatgatgaattgggctcatcagaaagatccgttttcccgttaacttgaacgaagcgacttggagaataaccgaggccgtttcaacgacaaaaatgataccaatcaaaagaagcgataattcatgatgtaataggatcgacacggcagctaaagccccaccgagcgctaatgatcccatgtcccccatgaagattttggccggtttatggttgtagacgaagaaacctagtagtgaccctactacagccaagcagaataacatcacgttatactgattttgagcgtatgcgatcacagcatacgcgccaaatgcaatcgtcgcctgaccagcaaccaagccgtccaacccatccgtcaagttgacggcgttggaaaagcccactagccagatgatggcgaagagcatgtaccaaatccctagtgaccagatcccgaagcccggaatcctaagtgccatcggcaaatgctcatgttgatagactaacgttaaaattaccgctccgacgacttgaccaagcaatttttgccaagcctttaagccttcgttttgtttgcgccacagcttgatactatcatcccaaaagccaagtgcaccgtataagacaaggataaacatcaaaatccaagtggtaggttgtagctgatgttgccacccgccgacccacagcgtggtgactaagattgcgatgatgaacagcaagccccccatggttggcgtcccggactttttctcatgccacttaggaccttcctcacgaatcatttgtccttctttgcgagcgcggaaataccgaatgagtgacggcattaacgcaaacacaataataaaaccactgattagggttgcaccccacactaataaactcacaacaattctccattctaagacttgataactacttcagtgtcacactaattgcctgctttgcttcaatcggattgcccgcagtcacactttgtgtcttgacgtaacccgtcccgctcgtcgtgagcttaactccggtcaacgtcgcaaagtcagcgacttcacttgccgaccagccagataggttcggcatatacatctgcccgttggtgaccaaaatgacacgttgaccactcgaaacaacggtaccagaagaaatggattgcttgacgacccgactacccttaccaacaacgaccacgtcgagtccctgcttcttagcagctttctcagccgcactagtcgtcttgctcgtcaaatctttcatcttgattgtcgtcgctttagtctcactagccttttgttcttccaaggcccgtttcatcacggtgtcaaagatttccgccatgtcatccgatgcagaactcccgttaagcgtcggttgtttcatcgtaatgtacataatgtactttggatttttagctggcgccatcccgacaactgagtacagataagtgttgtcgccttgctcatacgtactcccgttgctgacttgggcagtcccagtcttagcggcaatgcgatacccgctgatcttatatgatgaaccagtcccatatgacttgtatacgacatcttgcatatgatccaacaccttgctggcagttttcgaactgattggctggctcacaaccttcttcttccccgtataaaccgtcttgttggtattcgagttagtgattttagaaataaagtacggctgtaacatcttaccatgattagcaatcgctgtgaatccacgaagcatctgcatggcggtcacttggatcccctgaccaaaggccgtgtccgcttgttcaatcggatacgtaaattgaatcgaaccgctttgctcgttgtcaagaccactattagtgctctcgcgcaacccaaagcgtttaatgtacttcagccaagtcttggcccccattgcttgttctaggtgagccatcgccgtgttacttgaaagcgcgaaccccttagcataagtgatattaccccaaccattcgtattccagtcaggaacggtattattaccgattttatattcaccagtcggaacggtcacgttagcgttgtatttgccgctgtcgatcgccgctgccattgtaaagaccttcatcgtcgatcctggttcaaacgtgtcctcaaccaacaagttacgccacatcttagacaaccccgtcttcgtttgggcattaaacgtcggccgctgcgtcgtggccagaatcgcacccgtcttcgcgttcatcagcgtcgcggtcattgacttaggcgagaccttgtcgttaacttgtgacacttttgtttccagcaatgtctgtagtttactgtcgagggtggtataaatattatccccatccttgaccttcttaccggtttcagtgctaccttgatatccgctcttcgtaatcgtcttgcgaccatcggttcccgataactgcttgttaaaagccaactcgatgcccatcgaccccgttaaccgcgtctgatcggtatctttctgactcttggaggtggtcagcccaaccaagtgggaggcaaacgtgccgtttgggtagagccgcgcttcagattcaataaagtgcagcccagccacattttgggcatcgatcttttccttggtcgtcagtgaaatattcttaccagccgtcccaaattcaatttggaacttacctgcgcctttttgcaaggtcgcgagggctttcttatagctgattggcaaatacttcgataagacgcgcgccgccttcacgttgtttttaacatacagcgccttgccactagcactttgctgatttttcgccataatggcgtagaccgtgtacgtgctagtatcttcagcgattgggtcaccgttagccgtataaatagtcccacgtttggccgtgatggtctggtcttccgtataaagtttcttggtggcctcgaccagattgaccccgttgacgtggcgcacaatcgcgatatatgaaaaacgaatgatcaaaacaccaaagacggcaatcgcgccaaaaaatagccattggccaaaaattctacgattttgttttggtgaccgtttcgaagtcattcgttgtttgttcttattcatttgtaaacattccttatgctaccgttgttcagcgataacccgtactgcttagcaattttatttaaacggctccgacttgaaagttcactgatttcttgtgcggccgacgtatttttcgcctgcactttggtgactttcgtttgcaccgtctgtaactgactttgtgcgttactcgttgcaatgttcgttgaaactaacataatggctaatccaaacaccaccaaactcaaaccaacacacaatactttttcaaataatgaaaaagcaactcgctgcgtcttgatggacggattcggggtcacaacggtttttgttttatgtaccggggtgggtgcgccaggagtctgctgtggcagctcccgcgctaatccattttgggccattttaatcactcctttaattattcctgaatattatttatttgtaatctttaagcgttcgattgctcgtagcttggcactgcgagcacgacgattagcttcgatttccgcatcgctaggcacgaccggtttacgactgactaagcggtaatctggttgcatttcagctgggataactggtaaaccaggtggcagctccggcaaatcgctgtgctccttaaagatcgtcttgacgagacgatcttctaacgattggaatgtgatgacactgacccggccgtgaacattgattaaatcaatcgcttgttcgagcgaagtctccagtacgcccaattcgttattcactgcaattcgaatagcctggaaaacccgtttagcgggatgaccacccgttcgccgcgctcttgctggaatggcattcttaataatttcgaccaattgccccgtcgtcacgatcggctgaaccgcccgttcacgctcaatcaaccgtgcgacttgtttagagaacttctcctcaccatagcgatagaaaatacgaaccaagtccgtatagggccaagtattgacaactgtttgagcggttaatttctgactctgatccatccgcatatctaacggcgcatcatgttgatacgagaagccgcgggcagcatcatcaaattgtggcgacgaaacgccgagatcataaaccacgccgtcaacacgatcaatgccgcgcgcatttaattcggtcttcaggttggcaaagttacttttgatgaacgtgacctgaccacgttcaagataagtcgctaagttactttggttataatcgattgcggtttgatcctggtcaaagctatacaagtggccttccggacctaactgttgcaaaattttacgagaatgaccaccgccacctaacgtacagtccacgtagatgccatccggccggacgtttaacgcggcgattgcttcatgcaaaagtaccgttgtgtgttcaaatgttgccacgcgtgcgcccccttcctaaattattattgttatttaaaaatcaatcaagttttctgcaagattatcgaagttcgctgcggtctccgtctcaaactgttgccagtgttcggcaccccagatttcaaatcggtcagaaactccgacgatcacacattgcttttccaacttagcgtattgtctcaaggttgcaggtatcatgacccgtccctgtttgtctaattcacattcagcagcagcagcatagaaaaaacggacaaacgctcgcgcatccttgcgagttagtggtaaatcatctaactgtgcttgaagcgttgtccaccgttcagcgggatagccaaaaatacaaccatccatcccacgagtaatgacaaacgaagtgcccaatagctcacgaaacttggcaggaatgattagtcgccctttcgcatctaaggcatgttcaaactctccgaaaaacatcttagacgccacggccaatcaacccctttcattaaacataattcaagtctaccacacccccccacttcctaccacatcgttttgttacttttccaaattgttaacaaaatatcaaaaaaagtcccacctaacgttagtttcgttaggtgggacttagtgggggacatttttacgatattaaaaagaagtggctgccaagtgctaggatatagacgacgagtgtcaataattccgctccccgccaatagagcttaaaaaagcgccagtaaaggatttctccgcgttcaacagcttcaatcagtgttaaaccgatccccaaaatcattagggacaacacttcgtacggtgccagcgaactatccgttgcttgcagtgtcagaaagtgggtgaaaacaattaaaaatggtggccaaaaatctaataatcttaatccatgcggccaaacacggtgtgcaacccgtttagcgcctaaaacgatcatcgaaatggcggctaaaaataccagctgcccataccaagtgatccataaatctcgcatatgcgtacttgcctccccattagtgtcgggttaaattatagagattatcgttaaacttttcaatcatctgcgacagccctataataaacataaactatcactggagggatgaccgttgttacaatactttaccactggcaaaaatggcctcttgaccaccccggatgaccatcatgaccagccatactggatcaacgttgaacgaccgacccccgccgaaatcgaccaactggtgacgcaatttgatcttcctaaagattacctgactgctatccttgacgatgcagaagtctcgcgggccgagcagctaaccaacacgcaatccggccaaccaatcttaatcgtgatgcagtatcccaaactcacgaccagtaaattaggttaccttgaattccaagtctaccccttcgccttgattttagtggatcaagttgtcattactgtcagcaattacccagctagttttatccaagactttgtaatggacccggcctcttctaagttaagtctggataaccatgaagactttgtgctagccatcatgtggtacatcgaacacagttttgtcgccgcgctcacgttaatcaaccaccgtacgaccactctggaaagtcgcctgaatcaggccacccacaacgaggaactatttacgatcatggcttatcaaaaatcgttgattcgctttaaagctgcccttaatcagaatgcccccacgcttgacgcggttgaagcatcggtcacccacttcaatgcgcctaaccaccaatcactaaccgatgatattaagattgaaactcagcaggctagcgatatggctgatacgaccaatcagattttgcaacaatatagtcagttagttggttcggtcatttccaataatttgaacgatgtcatgaaattcttaacctcactcacgatggttttgacgattccgacgattatcggcggaatctatggcatgaacgtcaaattgcctggtgctggtctcgttcactccttcacttggctgatgttggggacgattatcctttgcattattagcatcgaatatttacgaaaccatgactatttttaatttcaattgaaaaaaaactgattccacgttaaactatgaaagaattactcgtaaagtgtggtgcatacaaacataatgaagaagaaatcaacttttcaaaaaattacgatggtcgttatttggttaatgatcatttctactattgggtcattggtgcttaccgccttatccgggttaggtttattaaccttctaggtttagacgacaccttgcgaattgcgacaggcttcaatacttatcccaaaattagttacggttgccgtgagcaagcgtaacttttttattgctggtagcttaatcatccgcattcgtcaaagccagtcaccaacttctaggacgatgtgacctaatcaacaactcattcagcgctcaaaaaggttccaaccgctagccaatttaggccagcgattggaacctttactttaacgtcaattattcaatcgtatgagcgacgtcaccacgtgaaaccgtgctagcccgacaaaagcattacccgacgctaggcgtcattacccggcgtgggtgcttcatcggccgatttttggcggtagaccttacggggcttactcccttcagatggccccaccacgccgcgttcctccatttcatcgacgattcgcgctgcccggttatacccgatacggaaccgtcgctggagcatcgagacgctagcggactgttgatcagtcaccaattcaacagcttcggcataatactcatcctcaccatcgcgagggtccccactaccagcggcatccgtctcgtcatctttgaccagcatactatcgtcataatcagccgtctgttgagctttgataaagttgacaacttcttcaacgtcatggtcagaaatataagcaccctgcacacgcagtggcttattcatgcccattggctgatacagcatgtccccacgaccaagtagcttttcagccccgttactatcaataatcgtccgtgaatctgtcccacttgaaacggcaaacgccatccgtgacggtacattggctttaatcaacccggtaataacgtctactgacggccgctgtgttgccaaaatcatatgaataccggccgcccgggccatttgacccaagcgaataatggcatcctccacttcgctcgaagtgaccatcattaaatcggctaattcatcgacgaccaccacaatgtatggtaagacgggccgtgactgcccatcagccgcattttgttgacggatatattggttgtacccctgcatgttacgctgcttggaatccgcgaacaattcatagcgtcgctccatctcggcaacgaccttatgcaacgcccgcgctgccttcttcggttccgtgaccacgggcgtcaacagatgcggaatcccattgtaaacccctaattcaacctttttagggtcaatcagcataaacttaacttgacttggtttcgtgttcatcagtagccccgtgatcatcacgttaatggcaaccgacttcccactcccagttgacccagcaattagcaagtgcggcatcttggacaagtcggcaacgactaaattaccagaaacatcacggccgagcggtacggccaacggtatggtcgggtgcgctggttgggcctcaacgatatcccggaacgagactgttgaaatctgtttatttggcacttcgattccaatcaaggatttacccggaatgggtgcttcgattcgaagatccttcgccgccagcgccaacgctaagtcgtccgccaaattaacgactttactgaccttgacccccacggctggatgtaactcatacttcgttacggatggccctaagctgacattcttcacttcaacttggacaccgaaacttgccagtgtcgttgttagtttctgcgagttactctcgatcgttgcgtactcagcactctgatccgtttttggaatcttcgtcaacaatgttgattctggcaactggtaatccgtatcatccatcacttcggtcccttggagttcttgttcatgatcagccgtggcagccgaagttggggttttagccggcggttcttcgcgatcactagccaccgtgatatttaaatcagcgggcgaactcgtagccgcactggcaaccgagctggccgcgggagcggtactcgttgcctcagcgggtgccgctgactgcggtgcggttgacgtcggttgcttctcagcactggccgcttgattggcgcgcacttgttggtgaacccgccaacgggcaatttggacccgcagcacgtgggccagccattcatagccggatcgcagttgctgtcccacttgtatcaaagcctgacgcaacgcttgcatcgtcttatggaacggcaaatcaaaggtaatgtagatactggcaaccatcaggatcaaggcgatcaaaatcgtcccgacattagccaatagtggatacgtgacactataaccagcagcgccgactaagccgccaccaagattactggccatgccccccttggcaaaatcatttttgatcagattccacgtcaacgaccaaaaatcggtatggtgattcaattgattaaacatcgggatctctaatagcaataagtaactgaagaaaaacaagttaccaccgacccaccaccgccaagtcagtcgtggccaccgaccaaaaatcatcaaatatcccatgacgaggagtgttagcccggcaaaaatctggtaggcattcccagcaatggctcggaaaaactctgcgaataccatgcccactaaccccaccttcaacaaggcgaggatcgtgaccaatagtccaatcaggccaatgacattccccgtcatctgccgcttagccgcaaccgtcggcttcttcttgcgcgtcgaggtccggcgcttttttgttgttgcttgtctacgcgccacgcttcgttcatcctttctcaattaatactgtcttcattataacaaactcaagttcccccgtccccatcaaaaaacgcaccctaacgtttagcgctagtgcacgttctgttggttacttcaacttatcattttcatagtggtgcgaccgttcaaggttcgggaattgttgttgccgcagggcttcataaatcacaatcgcagccgaattcgataaattcaaggctcgaatatgtgaatcatcttgaggaatccgaatggccttttcgggatatttgcgcataaatggttctggtaaccctgtcgtttccttaccaaataagaaatagtgatccttacccgtatcactataatcaacatccgtatagtcatgttcagcaaatttagacactaagtacaactgatttaaatcaggaatactagctaaaaaatcttgcaagtcagcatgataagtaatatcgacactatcccagtagtccaagccagcccgttttaagtgcttatcatcaattttgaagcccaacggttcaatcagatgcaaggccgtatccgttccggcacacgtcctggcaatattaccagtattcgctggcattaacggttcaaataacgcaatgtgatttgtcaaaataatcgtcctcattcatattagtctctacgccatgttcattcatagcaatcctattaatcataccatgtctatggttcaacagcgaactttgcaactaaaaaacgctttgttcgcattcttaaccaatctttcctatactaatcaccgtacgcgccggagggcggaacaggacgcacactggctgacgaacaccaatctaaacctgacacgttgtcatcatgattcatgccggattaacacgtacaaggcagcattcgaatcattttataactcgaggaggaattatctatgaaaattatgattattggcgcaaccggaatggctggctcagccatcaccaaactagcacttgaacggaaccacaccgtcgtggccatcggacgttctgaagaaaagctagccgctctaccggctaacccaaatttgcagaccaaagctaaagacgcttttgatctcacactatctgagctacaggcggttgacgtggtcattgacgcaatggcgactagtcctgataaggcttaccgacacgtggatctggcaactaagctgatcgctcagctccgcgaacaacagcggccacgtctcctcttcatcttaggggccggtagtttaacaactggtgatgatcaacacctcttcgtgcacgacattgaaagtaatccggccaatgctgccttcgtcgctattccgcaaaaccaactggccgagctgaccttcttacgaaccgtcaccaacgtcgattgggttggaatttccccggccgccaatttcacagcaggtcctgctaccccggcccagtacggccatgacacattactgacgaacactactggtgaatcagtgaccaatagtggcacgatggcggtagccgttttaaacgaactggaaacgcccaaacatcatcaagaacgctttacagtcgctaaccagtaaacgtcttgcctagcagtgctaaaatatcgagtggcagccaaaccacaagccgagcgctacttgagcaatttagttaactgtgacgcgctttaaataagaccaattaatcccgccagaatctgacgggattttgtggtgtcgcaattgctggcagtatttaacagctaagtgctgccaccgcctcatctctcctcattgcgacagtcgtagccaacattgtcactaaccagttggttgcattacaccgccagttaacgccctcaccgacctttaattaattcttcaccaaagcatgctaaactattgccatgtttatttgaaagtggggataccatgaataaccgtttatcaggacggaatttactcttcatcggcaccatgttatttggactatttttcggtgctggtaacttgatttttccaatttttctgggccagcaagccggccaacacgttggtgcggccattatcggactattgatcaccgggattggactgccattactaggcgtgatcggcatggggctgacgcgcagtcagggcgtatttgacctggcaacaaacgttagccgatcatacgcgtatgtcttcaccgtactgctttactttaccctcgggccactttttgcaatgccacgattagcaactacggcctttcagattggactggcccccttcttaaccaccaaattacaacccgtggtgctattgggcttctccgttgcttttttcgtcgtcacttggttactggctcgtaatcccggtaagattatgacctatgttggtaagtggctgacacccatctttttgctattattaggtgccttaatgcttgtcgctatcattaagccactgggatcacttaacgtcgcggcgagtggcgcctatatcagccatccagttctaactggttttactgaaggctacaacacgatggatgcgttagcctcgctagcttttggcatcgtcgtgattgatgcgattcgcgacctcggtgtccgtgatccggggcaaatcgcaactgataccattaaagcaggcctaatcagcatgagtttaatggcagtcatctatggtctgctggcgattatgggtaccatgagcttaggtcgctttgctccagctgccaatggggggattaccttagctcaaattgccgatgcctacttcggccgattcggtaatgtcttgctcgcgctaattgtcatcatcgcttgcttaaaaactgccattggcctcacttctgctttcggtgatacgttgcatggcatgtttcctaagatttcctaccattggctgatcaccgtcgcttgtctcattccagccattcttgctaacgttgggctaactgaaatgattacttattcaaccccagtgctgatgtttctctacccgctcgcaatcgtgttaatcatactggcagtactggcaccatggcttgggatgtcccactggttatatggaatgacaactgtctggaccatgattccggccattcttgccggcattaacgctatgccatccgcctgggtacaagcatcctggttgcaagctttgcttcatctcaacgcgtggctaccgcttgccaatctagggttaggctggagtgtacccgcactgctaggttttggtttagggtggttgatcagccgtaaacaaccatctgcttctaaattgcattaatatagcgtcacatataaaatagcggaccttctgatagccatccacgacttttcagaaggtccgctttaaattacgagagccatgccaattgactggttgccattgaacctcaccggtgaatcatggcattattcaggactggtatgaatgcaatagcaacacatggtcacacctcaccgtcagcttttgaagactttgaaaagattctaaacacgttctaagataccgatgaacttaaattcgaaaagaccttcatggtagtgccagaaacgcggaatgtgtggattataacttgaccaaatggaaaggactgtcacggtgatgggcacaatcactgcgatccaacccacgataccaacgatcgtttggcgaatcttgagtccccaatggccagtgtcaaagtacgcatcagagtatagttgctgccgattaacatcatcagtgattggtttaggcatcgtggttctcctttgtggttgattgctggggattgattggatggccgaataagtagccttggcgaatgctgatttgcagttgctcggcgagctgttcatcggcctcattttcgattcccattagaattagatcaatattgttttccttagagagctgattccagaattggaggttcaggtccagccagacggatgggtcttccttgcgaaatgagcgcattgagcatttgagcgtgtcgatatcttttaaaagccactgaatgtttttaagattggctagacttgcaccgacgttatcgattccaaactgcatgccgtaaccgcgggcttcacgaattcgccgccgaaataggcgtttattgatacgacgtggttggtattgaggtgtgtactcaattgccaagtgcatcggttcgatgttcgcaattgcccagcgaacaaaataacggaattcgggactgatgatttgttcgtattctaaattgattgataacgtaatcgcttcatcaggtagcgccttaaaggtatcttcaagcaggaagatcacccgctgaagtggaagtgagtcaagttgtggtggtaatgaccacgaaccatcagtattttgttgacgcaggagacattcatagccggtagtgcggccacgaaaatcgacttgtttttgaataaagtagcgtagattaaaatcatcattttcaaggtaattgttggaacgtttgcgggagtaccaatagtaagtaccaatcgtcaggatgaagatgaccgcaattgagcctgtcaaccacagtaatcctatttctaattgtgctagactcatctaatataatctccgtaagaaaaacttatgataacaggaaaggcgactaaccgtcgtagttgacagtgtcaaacattttgacattataggcctaattttgcacagtttcaacaaaaattatctcttgataaatagaaataacttttgattagcgttaatcagtcctgtcttatgaacgaatcgcgcaaccgcacatcaacactgtttagccaactaaaccaccagtgattgacggggttttagtggtcgcttataatcgataatgactttgacggatattttaataagtatagaagagggttatcataaaatgaaaattgttttaacgggttcaatcggtcgtattaaccagaccttggtacctaagctgacccatgctggtcatgaagtgacggtcatcagtcatcaagcaactcgcagtagtttgataaaggtttttcgcgcaacccctgccattggtcgacttgatgacgaagcgtttttgaccaagacgttcatgggcgctgacgtggtatacctcatggtaactggtatagcggcgagtgatgatctttataccgctgccaaacgacaagcggacatctatgccgccgcgatcaaggcagccggcgtaaaacgagtggtgaatctgagtagcgtgggggccgacttgggaccagaagtcggtgcactttacatgtatcatattatcgaacaaacgttaacaaccgctttaccagacgtggacttaacgtttatccgcccaacggcaatgtactataatttactgagcagtgtgccaaccgttaaaaagagtcatcgaatctacacaaatgccaatttggctgttaagaacgtgtgggttgcgccggtcgacgttacaactgtactgattaaggcgctgaccgaaccgacaccggggcaaacagtgacatatgttgcgagtgatgagaaaacttatttggaagttgcttccgcactgtcacaggctcttaaaatgccggatttgcgcgtttcacaagtgcctgatgaggtcatgcaagatcatttagtgactgccggaaccccggtcgcatttgcacgggaatatgttaaaacggtcgcttaccagcgtgaccacgatttttacgcggattatcgagcacatcaacctcgattaggcgatgttaaacttgctgactttgcccaagtctacgctgaagattaccataatcaacaagttcttaaacactagtaggcgttagatgcagccgtgcctactaaaaaacacccctgagttaaacgactcaggggtgttttagactgccatcattgcttagtgaaccatcagttctaagcgacaaatgcaaagtagagaatgaagacgaccatcatcgtccacatgagggcgtttacttcacgccaccggcctttgaccgtcatggtgattgggtagaagataaagccaacggccaaaccttctgagatactataagttaataacatcataatcatggtgaaaaaggctgggacggcgatttcaaacttggtccagtcaatgtattggacgtttgatagcattaaaataccaacgataatcagggctgaagcggtcaccgcggacgtaatcaccgtcaaaattggagagaaaaaggcggcgatggcaaacaagagggcaacgaagacggaagataacccagtacgggcccccacggcaacgccggaagtcgattcaacataagccgttgtcggtgacgtgccaaagactgctcctaaagttgtggcgagtgcaccactaaagagcgctttaccaacgcctttgacttcgccggattctttgtccaccatgccggcttcggttgccaccccaaccaaggttcccgacgtatcgaaaaggccaatgatgaagaacgtcaggatgacaatgatcatttgaaacgaattaatattaccaaggtgtgtcacggcttgaccaaaaatcggttgaacgctcggaaccccactgataatcccagttggtaggggaataatcccgaagatcattccgactgcggcggtgatgaacatgccccagaaaataccaccagttacattagcggtgactagcatgatgccgacgataatcccgaaaatcgccaacaaaacggtgggactgtgcaagttacccagggcgaccgcgttggacttattcgcaacgataatcccggaggtttgtagtcctgaaaaagcaatgaacaagccaattccggcagatacggcgtattttagcgcacttggaatcaagttgatcagtttatcgcgtaacttggagagcgttagtaggatgaaaagaattccggcaacaaagactcccgccaaagcggtttgccaaggaatgtgccattcctggacaactgtataagtaaagaaggcattcagccccatccccggtgctaatgctacgggaaagttggcaactagccccatcaagagacaaccaacaatggccgctaaaatcgttgcggtgaagacggcggtcttactcataccagtacttcccaatagttcgggatttacggctaaaatatatgacatggctaaaaaggtcgtcagaccaccaatcaactcgcggcggactgaagtgcggttttcacgcaaatgaaataattgttctagaataatgacccactcctaaaattaataaaaaactaacaattcaacaattgtctagtataacatactgatttttagggtaacaggggattaatcagtttattgcctcacgatggcttgtttttggaatggaccaggtttagatgactcttcggcagcatgggcaagttttatgccaagtcgaaagaaagttactttaaaaaaagtcttcatcggtacgacgcttgacattcagcaaaaaatggcagtataaagcaatcaatagaatgagagcggctattaagtagcagaacaaaaaaacagcggttcactgccagattaggaccgtgaactgctgttattaagcgtcataattaaggttgttctgtttcattgagaccgactgattcatcatcaaccgtgttttcggctgcgtggcggttgaagagtaagttaaggccaactgcggctacactaccaacgaccaccccgttgctcaacatgatttgaagtgcaccaggtaagaattggaagatattggtttgcaccgtgacgcccaaaccaagaccaatcgaaacggctgccacgagtaaattattgttattgcggaaatcgacttgagctaacattcgaatcccttgaatgccaacgatcccgaacatgacgaccatggcgccaccaagtactgggtcggggataatcgtcgctagcgcaccaatcttaggcagtaggcccaatacaactaagaacgcagcggaaaagtaaattggctttcgcgtcttgacaccagataattgaacgacgccgacattttcagaaaacgttgaataggggaaggtactgaacaagccaccgaggatgacggcaattccttctgcccggtaaccacgttttaaatcgtcgccttcaattttacgaccggtaatgtcgccaagggcaaagaagaccccggtcgattcaaccatcgttgttaaggagacgaggatcatggtcaaaatggatgaccattcaaagtgcggggtcccaaagtaaaagagggtcggtaaatggaaccagctagcttcagcgacgggttttaaagaaaccatccccattgccccggcaatcaaagtcccaactaaaataccaatcagaatcgaaacggatttcatgaagccacgtgcaaacacgctaattaataaaataattgcgatggtgagaaaaccaatgccaagtgcttgcacgttaccgaaatccttggcactggtgttgccgccaccaagattttggaaggcgactggaatcagcgtgaatccaataatcgtgattagcgatcccgtaacgactggtggaaagaggttcttgatctttgaaaataagccggcaatcagaaaaataaaaataccagcaccaatgattgagccgtacatggttcccagcccatatgttttaccgatttgaatcaacggattgacggcttgaacggcacagccaagcacgacgggaagcccgattcctgttagtggtgtacgttttaattgtaggaacgttgcgatcccacacatgaaaatgtcgattgagactaggtaagttaattgttcttggctgaaatgcaaggccgcgccaatcaataatggcacgagcacatcacccgaatacatagctaacagatgttgaaaccctaaaatggccgccttaacattggtaattttaggtgctgcggatacttccttcaaatcaatcttcctctctcgattaagctgatttgcctataaaaaaagtcaccccggcaaacgggataacctcgtttgcttatagtccaacctttacggggttgggtagaaactcgtcaaccatatcatgacattatataggcaattaccacttatttgaatgagacttattctagcacagatgaaaaccgaatacaaatgtagccgaataaattaatgttcgtgaaaacgatatttttttggaagatgaaaatgaaaacgttcatttttgtgattgttgattatgccaaagtagcactgccatttctagtgtttgggtctgttcaggatcgtccaagttcaacgttagcattttttcgatctttttaaggcggtaaatcaccgtattgcggtgaatatctaggtggccggccacttcggcaatgttttgatggtaataaaaatagccatacagggtcgtgagtagattaagttgttcattcgcactgacaccactgacgagtccacccaagacccgttcgacaaacgatcgcgcttcattttgtggaatcagtgaaattagttccttgacgtacttgggccgatagatcgtgactgcgtggggactgtttttgctgagtgccaaggcttctgccgcttcattataggttgttgcgagttcggttagtggtagcgtcgaataactgtaaccagcaatcaaacgcgcctgtctgtccaactttggctgaataaattgaacgagggcggtcagaaagtgctgggcattttgctggtcattgattaataagaccaattgctgctttaatgaaaaaacaatgacggatgcttggtattctttaataaaccacagtgtcagttgctgaacctgttccaagagatggttacttaagagggcctggtgattagtcgtgactaaaatggtggcgcagtggaacttcgtactcggatcaatattgcgggctttcagagtcttattcacgaggtcgtttgaaataccgccatccattacgtttaagtagaaaccactttggttgcggaatgcggattcgtttaacatatccacccgaccattgacgaaactcaaggtgtttaagacgacttgcgtcagcatctgatcagttgagttggccgggtccaagtcgacgacgcctacaaaggccttattttccttataagccgaaaatagtggcatgatggtcaggtcatttgcttggtaagggagaatgacgcgggtattgaggttgaaatagtcgatatcggtttgattgcgtaaaaaatcagtcaaggtattgcgggtcatcggtaaatcttgggaagcactgaccacccgaaaatgactatccattaagaagagaggatgatgaattagctcgctacatttattcaagaccgtggtgttggttgggtctttgagcaacaaatccgctagtgtttggtttgccttgacgatgcgactgagctcattagtttgtgactttaagatgatgctcagcattttgcgcatggtttcagaaatcaactcatcaccgggcgtaataatgattggaaaagcgagttcgttcgctaattcaatcactttttttggtaaatggtcaacgtaacgatgatccttaaatccgagaccagcacagttggcattgtgcatcgccttgatcaaagttagtgggtcggtggttgtattgacgaagggatagccgttcgtaatcaaaaactgaccattagcaaggtagtcagcaatgtcaggtgactcgatcattccgatattactaatttcgcgtttgagaccgcgttcacccgcaattacccgcatatgttgcattgatggtgtttgtaatagtgtttgtaaacgcatggtaagtccccctacaattagttatctttaacaagtagtataccgataatttggcagtttgactataattaaatgaaaaatagattaaaaacaaatgaagcgtcgaaccagtgttatgggttaaggaatttaagtgttggaaaggtttatcctcatttgagcgcaggagtagccggcgcaggactgctgaagaaagttttgtttagtgtaaattcacctggttagggcgttggatgccgatatacagaaacgggattcgctcgggttgagacttccagctagctaagtgaaagttcacccctcaacgtcgccgttgagataatcttcagtttcaacccgtctgaacttcaccggcttccagtgctgagtattgtcagcaacgccttccagtcgaggtgatgttcaagtgacgggtggacttaacttttgctgagtttgttgttgctcataaaggggagatttcgcatataatgatattttgatagaccatttgttgctaaattagcacgttaagattaaaacagtcattaaagtgaattgatggtcccccagctttaattgaagttctaatatcaacggattcaacgaccaatggtactaatattaggcgaccgctcatcatttattcttagaggccggaataagacgatcacgtgtcacgattggaaatctattgaactcgccaggtttctcaatgatgcttgtcaacaaaaagggcaaatggccaaagtcgtcagataattaacgcgacttaagttgattagtccttgacagttgtggtggagttcgttaaacttagtccaattaaacaagcacctttaacttagtcctgtgaggctaacaaggggaacggtcatgtagggtctcccacgcttttcgcaggaaaacagggtgactctttttttaccccgtggattaaggtgaaattacagaaatggagctgacaaactaatggcacgagaagtcgttgatgcaatgaccatgcgccgcgcgctgacgcggatcacttatgagattattgagcagaataagggtgttggtaacctggtatttatcggtatcaagactcgtgggatttttttggcccaacggttagcgcaacgattgaaacagttggaaggcgttgacgtgccagttggttcgttagatatcacgttatatcgggatgatcatcatgcggttgatgttgccggtcaagcgaagctaaatggtgctgatattccggttgatatcaatggcaaacacgttatcttggtcgatgatgtcttatttacaggccggacagttcgggctgcgctagatgccttgatggaccatggacgtcccgcaaagatttcgttagcggtcttagtcgatcgtggacatcgtgaattaccgatccggcctgattttattggtaaaaatattccaacggccttggatgaacaagtcagtgtcgcccttgaagaacacgacggacatgatggaattagtattgaaaaattagaagaatgatttaattgaataaaaccatttaattgtttccagagaggaacgaaacggtttggtcatgcgtgaccacttaatcggagtctagcctctttgcaaacatttttgcggaagctagactttttttatatacaaaggagacggcaatagccatgaaaacgagtcaaaacctagttagtgttgaacaatttagtaatcaggacgtgatggcctacttgaagttggcccaagctttcaagaatgggaaaacggtacaactgtcacagccaacgtttgcgatgaacttattttttgagaatagcacccgcacacatacaagttttgagatggccgaacgacgattaggattacaggtgattccgtttgacccaaagactagttccgtgactaagggcgaaagcttgctggatactttgaaaacgattgaagccattggcgtcaacttggcagtggttcggcatccacgcgatcgttattatcaaccacttctcgacgccgggtttgacatgagtttgatcaatgctggtgatggtagtgggcaacatccgtcacaatcgttgttggatatgctaactatttatgaagaatttggtcattttgatggtttaaagatagctattgtgggtgacttggcccattcacgtgtggcccgttccaatatggcgttactgacgcaactaggagcccaggtttactttggcggccccaaagaatggtatggccgtgactttgaagcatacggcgaatatcagacgatggaccagttagtcgcaacgatggacgtcatgatgttattacgtgtccaacacgaacgattatcgcaagtgaacaatcagaccttcgatgcgtctgcctaccatcaacagtatggtttaacagctgagcgcgccgcacgaatgcccaagcatgcgattatcatgcatccggcccccgttaatcgaggtgttgagctagcgagtgacttagttgaagcgccgcaatcacgaatttttcagcagatgacgaatggtgtttatattcggatggcaatggtggcgagcgtcctcgctcatcaaggattaatttcagcaactcaagtggaggtttaacgcatgacaacattaattaagaatgctcaagtgtggcaagcagggcagttacaaacaacggatatcctgattgccgagggccgaattaaggcgatcgggcatcaactgcacgatcagtttggaccggcggatcacgtcatttgtgccgatcatcactttgttagtccgggctttgtcgacgtacacgtccatttacgcgatcctggtcaaacagcgaaggaaacgattgcgaccggaacgttagccgcggcgcatggcggtttcacaacggtcggagcaatgcctaatgtggatccggtacccgatacacctgagcgggtcgcgacgatggtggcgcgtaatcagcaggaagcacatgttcacgtcgcacaatatgccagcattacgactgggcggactagtgaacagctcgttgactttgccggcatcaaagctgcgggggcctttgccgtcagtaacgatggttccggtgttcaaacggccggaaccatgtttgcagccatgcaaggtgctgctaaagttgggttgccattagcggcacacgttgaggatgattcgctttatcatcatggcgtgatgaacgcggggcccgttgctgatcggctaggattgcctggtatcaataatgtttcagaagcggcccaagtggctcgtgatgtcatgttggcggaagcgagtggggttcactaccatgtttgtcacgtctcaacggcggaaagtttacgcgtgattcgcaatgcgaaagcagctggcatcaacgtgacttgtgaagtatcgccccatcatttactcctttgtgatgaagatattacgatggataacccgatgttaaagatgaatccaccgttgcgttcagccaaggatcgcgcagcgttagttgcgggattgttggatggcacgatcgacatgattgcgacggaccatgcgccgcatactgatgccgaaaaacagggcagcatgaagacggcagccttcgggattactgggattgagactgcctttgccacgctatatacggcgctggtcaagacccggttactgacgctcggtcgtttaattgaactgatgagcacgcgtccggctgaactatttggcttaaatacagccggccggttggtggtgggggcaccggctgatctaaccattattgatttagatcatcaatatgaaatcgaagcggccaccatgttatcgaaggggcacaattccccgtttatcggttggcccgtttatggcaacgtcttaatgacactagttgacggtaagttggcatatggaaaggaaacgcaagcatgaaacgatacttagtacttgaagatggtacgatttaccccggcacggggtttggtgcgacaacggccacggttggtgaattagtctttaataccggcatgagtggttatcaagagtcgatcacagaccagtcttataatggcgaaatcttgatgtttacgtatcctttgattggaaattacggcattaatcgggatgaccatgagtcaatcaagccaacttgtaagggcgttgttgttcacgaagttgcccgacgagccagtaattggcgtaatgctcagtcgttggacgattatctaaaacagaatgcgattcctggcattatggatattgatacgcgggcggtcactaaacatatccgaacgaagggcgcgatgaaggccaccatcgtcgataacgtcttaccagatacggttgaccggctcaaagtcacggaattaaatcgggccgttgttgcccagagctcaacgaataacgcctatcccaacccagcgacaggccccaacgtggtcgtcgtcgactttgggttgaagcattcgattttacgcgaattagcaaagcgtcaatgtaacttgacggtgttgccgtacaataccacggcgagtgaaatcatggctttgaatccggatggtgtgatgttgacgaacggccctggtgatcccaaagatgttccgggagccttagagatgatcagagaagtggaaaaacatgtgccgctatttggaatttgtctcggacatcaactttttgcgctagcaaacggtgcggacacgttcaagatgaagttcggacatcgtgggtttaaccatcccgttcgtgagattgcaactgggcggattgattttacgtcgcaaaaccatggttacgcggtggatcgggattcattagcgcagactgacttgttgatcacccatgaggagattaatgatggtaccgtggaaggcttgcggcatcgcgactacgcggccttttccgtgcaatatcatccggacgcagcgccgggtcctcacgatgctgatcatatttttgacgaatttattgatttgatggcggctaatcaagcaacccagaaaggaagccaattcaatgcctaaacggacagatattcataaaattatggtaattggttcaggaccaattattattggtcaggccgcagaatttgattattctgggacacaagcttgcctggcattaaaagaactcgattatgaagtggtcttggtcaattctaaccccgcaacgattatgacggacaaagaaattgcggaccaggtctacttggaaccaattacacttgaatttgtttcacagattctccgcaaagaacatccggatgcgattttgccaactttaggcggccagcagggcttgaatatggcgatggaattatctaaatcgggtattctcgatgagttgcacattgaactgttaggaacgaagctcagcgcaattgatcaggcggaagaccgggaacaatttaaggcactgatggaagaattgggcgaacccgtgccagcttctggtattgcgcggacggttgacgaagcgttggctttcgctgagcaagctggttatccggtcatcgtgcgaccagcctttacgatgggggggactggcggtggcatcgccgagacgccccaacagttacacgacattaccgaaaatgggttggcgttatcaccagtgacccaagttctgatcgaacaaagtattgccgggtacaaagaaattgagtttgaagttatgcgtgatgctgcggataatgcgatggtcgtctgcaatatggaaaattttgaccccgtggggattcataccggtgattcaatcgtctatgcacctgttcaaacgttagcagatcgcgaagtgcaattattacgggatgctgctttgaagattattcgggcgttgaagattgaggggggctgtaacgttcagttggccctcgatccgaatagttttaattactatattattgaagtaaatccgcgggtcagtcgctcatcagcgttagcctccaaagcgactggttacccaattgctaagatggctgccaagattgcagtcggcttgcatttggatgaaattaaaaatccggtgacgggaaccacttacgctgaattcgagccagcgttggactacgtggtttgcaagattcctcgctggccgtttgataagttcacccatgctgatcgtcgtttgggcactcagatgaaggcgaccggcgaagtcatggcgattgggcgcaatattgaagaagccacactaaaggcggtccgatcactagaaattggggtgcaccacgttgaagaacccgctttgcgtagtgttgacgatgatgtactcagcgataagctcattcatgcgcaggatgatcggttattctacttaacggaagcaattcgccgcggttacccgattgatgaattagccgaactcactaagatcaacgtgttcttcctggataagctattacacattattgaaatcgaacaagccttgcgtacccatacggatgacttagagacactaactgtcgctaaacgcaatggcttcgccgatcaaacggtagctgactattggcacgaaacgatcgaccaggttcgcgacttccgcttagcgcacaaactagcgccggtctataagatggtcgatacttgtgccggtgagtttgcttcggagacaccttattattacggcacttatgagtttgaaaatgagagtattgttacgaaacgcccatccgttttagtgttagggtcagggccgattcgcattggacaaggggtggaattcgactatgccaccgttcactccgttaaagccatccaaaaagctggctatgaagcgattatcatgaatagtaatccggaaaccgtctcgactgatttctcagtatcagacaaattgtacttcgagccactgacgattgaagacgtcttaaacgtgatcgaacttgaacagccggtgggcgtcatcgtgcaatttggtggtcagacagcgattaacttagcgaaaccattagctgaccatggtatcaaaatcttagggacgagtgtggcggatgtcaaccgtgcggaagatcgcgatgagtttgacaaggtcatcaaagccttggcgattccgcaaccggctggtgatacagcaagtgatgaagcgactgcgctagcgattgcagataagttgggctatcccgtcctggttcggcccagctacgtgctcggcggtcgggcgatggaaatcgttaagaagcgcgccgacttggactactacatgcataacgcggtcaaggtgtcgcatgaccaccccgtcttagtggacagttacttagtcggcaaggaatgtgaagttgatgccatttgtgacggtcaaacagtcttgattccgggaattatggaacacatcgaacgggcgggtgtccattctggcgattcgatggccgtttatccgccacagtcactttcggcggcggtcaaagcacaaattgtggattatactgaaaaattagccattgcgctcaactgtgtcgggatgatgaacattcaattcgtaatccacgacgaccaagtttatgtgattgaagtcaatccgcgcgcgagccggacggtgccattcttaagcaaggtcacgaacattccgatggctcaagttgcgactcgggcaatccttggccagtcattggctgaacaaggttatcagactggcttggtcacaccaggacccttagtacacgtcaaagcgccggtcttctcattttcaaagttgaatcgcgtggatagtttgttgggaccagaaatgaagtcaaccggtgaagtcatgggcagcgatgtcacgatggcgaaggcactttacaaagcctttgaagcggctaagcttcacgtgccgagccacggtaacgtccttttgactgtccgggatgaagacaagccagaaacggtggcgttagccaagcggttccatgcgttgggctaccaattgctagcgactcggggaacggcgactgctctgaccacacacgggttacccgttacgaccgtcgacaagatcgatagtggcgagcatgatttgctgcatcgcatggaagctggcgaaattcaagtcgtcattaatacggtttcggatgaagaacaggctgaaaatgatggtaccctgattcgaaacacgtcaattatgcacggtattccgttgtttacggccttagatacggtcgcggcaattttgcaagtacgagaatcacaatcatttgtaacgcaggcgctctaaatcaggacacccgccgataagcttgatcataggaggaaaacgatgggacgattaacagtaaatttagccggtgtcacgttcaaaaatccggttatgccggctagtggtacggcggcatatggtcaacagatggctcaacagttagacctgagtgcgctggggggcttggtcatcaagtcgaccaccgccgaaccgaaagcgggcaacccacgaccaacgaccgcggaaacaaccgcggggtggctcaatgcaattggactcaagaatcccggaattgacaatgtgctggccgataaattaccgtggttagcgactcattatccggatttaccgattattgggagtgtcgcgggggcgagctttgatgaatacgtggcagtcgcacgaaaaatggcgtcggcacctaacgtcaaattattggaaatcaatatttcatgtccaaacgtcgaccatggcggcctagcatttggaactgatccagcgacggtaacggcgttgactaaggcgattgttgccgcggtcgataaaccagttttcatgaagctgaccccgaatgtcactgatattgtcccaattgcactcgctgccgaagctggtggagcggctggactgacgatgattaacacgttaacgggtatgggcatcgatttagccacgcgccaaccgatcttagcgcatggtacgggcggcttatctggaaaagccattcatccacttgctgttcggatgatccatgacgtgcgtcaacacaccaagttaccgattattggagtcggtggggtgttcacgccagcggatgtcctggagttttacttggctggtgcgaatgccgttcaagttggggccgcaacgtatggtcacccgactgcttgttcagacattattgctggattaccggcggcaatggatcagtacgggatcaccagcttgcaagcgttgattcaggaggtccaaggatgaagcgaccaattatcattgcgttagattttcccaccgccgaacgggccttagcttttttagaccaatttccggctgatttacatgtcactgtcaaaatcggcatggagttattttatgcagcgggaccgagtattgtgacggacgtgcaagctcgcggccatgcggttttcttagatttgaaactacatgatattcccaataccgtcgaatccgcaatgcgggtgatcgggcggttaggggtaacctatacgacggttcatgctgcgggtgggcacgtgatgctttcagccgccaaacgaggattggtcgtgggtgcaatggccgctggagtcactgcccccaagttattagcgattacgcagttaacttcgactaatcaagctattttgaatcaggaccagcaaatcatgggaacggttcgggcgagtgtcgtgcattatgccaaactagcacgggcgagtgactgtgatggcgtcatttgttccgcccaagaagttcaggcgattcatacggccgtcggtgctgattttcttggaattacgccgggaattcggccagcgtcggcgcagtcagatgaccagcaacgggtgatgacaccggctgccgctgctaaggctgggagcaacggtctcgtcatcgggcggccaattacgcaggctgcagaaccagttcaagcttaccgagatattatgacagaatggagtaactaatatgagtaaaattgcagcaactatcgccactgatttgttgacgattaaagccgttacactacgaccaaacgacccgttcacctgggccagtggcattaaaagtccaatttatacggacaatcggctgacgatttcctatccggcggtccgtcagcatatcgcgcacggaatcgccgccatcatcaagcgtgaatacccggcgaccgaagtgattgcgggggtcgcaacggctggcattccgcatgcagcctgggtggcggaattgttaaatctaccattgatctacgttcgtgctaaacccaaggatcacggtgctggccgccaaatcgaaggggtgttaaagcccggtcaaaaagttgtcatgctggatgatctgatttcgacgggtggcagtgtgttacaggcggccaaggccgttcaagcagcaggtggcgatattcaggctgttggggcaatcttcagttatgccttggatgcggcaacgcaaaattttgccgctgcgtcattaccgctgttcagtttgtccaactatcctgaactaatcaaagttgctcgccaagcagattacattgatgacgaggaattagcttcgctgcatacgtggcgtcaggacccagaacactggggagtgactgattaggattacgcgccataaatggctggcatatttaaaatagtcatgaaaattaagctggattatccagacgattttcatgactattttagttaccggctcgtgctaatattaacctgtgacagattgttaagacaagataaagaaatgagggaatattcgatgttagcaattttagttggcttagcaatcgggattgggttaccaatgcaaacgagtattaattcgcgattgcgcaattcagtgggatctccatttggtgcctccctaatatcttttgctgtggggacgttgtttttggcgataatgacactaattgatgtccatactttaggattttcgacgacgttatttacgagtcaaccggtttggatttggctgggtgggctgttgggggtcgtctacttaactggcaatatcttgttgtttccgaagctgggtagtgttcaaaccgttattatgcccgtgcttggtcaaattttggccgggctattgattgataattttggttggttcgactcaccccaaagtacattgacgatgacccgatttttgggtgcaattttagtcttggcgggagtcatcatcaccgttgcggctcaggggtggctcgaacagcggcataatcgaatcactgaaatagcggaaaaagatacagctactgacactgacactgaccaaagtggccttggaatttggcgtgcactaggtgtggttgccggaatgctcagtgcgatgcaaactgcggtcaatgggcacctaggtcgggtgcttggctccacagtgcacgcggcatttgtttcttttttagttggtactctggggctgatcgtcatcgtgttagtcttgcgacctcaattcaaattgcttaggccaactaagacgcctaatccttggtggatgtggattggtggcatgattggcgcgctgtatgttttgggtaatgtttacttggttccggtcgttggcactggtttagcggtcgtcattgttttagtcggactgatggccggtagtttaatgattgaccaatttggctggtttgcttcaaaaaagaacccaatttcgggggtccagttgatgggcttgctggtcatgattgtgggggttgtgctaattcgcgtcttttaagcactctgaggattggcgagtgtcaccgggtgatcggtaaggtgttttgaggtcgagacttgcagccggatgaataagcggccgtgcgagttgaccacattaagccgtgaccacgttcgttaaagcttctaaaatttcaaatcaggatgacaaaacggtactggatgccgggcacgataagccattataaatccgacgcacatctggcagcagtggccgtcaacgttgagaattaagacgtgcagcacacgggtcacctggctgaataacgtggtatttaatggacgcgataataaacatttaacttacgggttaggtgtttttttagccggttaaatatgcgataatgagactaacttaatgagaacgtttgttcagttcagaggaggaattagtggtgagcttacaatttgtattgggaccagccaagatggaccatcgccgtaccatggtggcgcagttagtggcaaccttgatggctaagccacaagatcagtttttttatttggtaccgaaccatattaagttcgatactgaagttgacgtgttgaaccgcttggcacaggcatttgggcaaccagatttgtatgcccagactcaggttcaggtcttttcatttacccgtcttgcttggtacttgatgaagaatgaagcagcttatcaagtaccacgactctccgctgctgggattgacatgctattatatcgcattctacaacgacatgccgatgagctgcgattgtttggtggtgaaatctcgcaaacgggttttgtgactcaactagctcgtgaaattaatgagttacagaccgctaatttgcaaccagaagatgtagttcaattggcagcgaatgctcaggcgggtgacttgcaggctaagctacatgatctggcgatcgtttacaaagacttcgtggcggcgactgcagataagtatcttaagcccgctgatattctcgttcaattgaatgcttacttacggcgtcaagacttgcacggaacgcacgtttatgtggaactcgctggctttgcccaattaccggcccaggaacagggcatcatcacgacgatgctggaacaaggtgcggacgtgacaatcagtttgatgcttgatcataaagttgtggatcatgcgcctgaaaacgggaccttattttatcaatctggtcggctttattatcggctctatcagtatgcccgtattcggcagattccggtcggccatgatatttatgctgacacgccgcgcgtggctcccggcttagtggctctcgatgatttttggcgtggtcagccccaagcggctaccggtcacgaggagccgaatacgaatgtgcatttattccggaccgatagtcgacagaccgaattggcacaagttggccgcatgattcgggcaatggtcgcgaaaaaacatgccaatcccgccgatgattatcattatcgggacttcttgatcatgacacggcacttagatgcctaccaaacgatgttagcgccgacttttcatgaattagaaataccatactttgttgatttacagcgttcaatggccgaccatccgttagttgagttgattaacgcgttgtttgatatcgacgcacagcagtatcaatatcgtgatgttatgcgcgtgttgaagactgagcttttgataccaatcgttgatggccaaccgatggatcggcaagcctaccgccaagcagtagatctgaccgaaaactttatccttaaaagtggttatcacggccagcggtgggtacaaagggaagattggcaatactttcaattaaccgagggtgatgccggggtcgagacggatcaaaatgctgaaatttcgcgacaaatcaacttgattcatcactttgttgctgaaacgttaccaccgttttttaaaaaaatacggcaagcaccggatggcaaagcggccgtgacattgctggtcaactttttgacaagccagggcgttacggaccagctattagcttggcgtgatcaagccttggatcgccaagatgtccgggcagctgccgagcctgagcagacctggcaaactttctgtgggatgctagatgaatacgtgacgattttaggtgcagagccatttgaaattacggactttttggcactattacaagcgggctttgaaggtgctagttactcgcaaattccgtcgacgttggaccaggtgttaatttcagagagcggaatggttcaaagtcaggaccataaagttgtcttcatggtcggggcaaccgatttagtgatgcctgaccggattatgacgaacaacttattgagtgatgtggataaagaaaatttgcaaccaacgctcagttcgttagatggtgaccactatttaaatgattcagctgtcgttcagctcggtgatgaaagttgtctgaattatttggcctttttaagtgcccgtcgacacttgtttttcagcgccccgttaaaagatgatcaagaaacagatttaaattggtccaactatgtgcggcgaattcaacgccagttcaatttgcgagaacatacttatcttgggacgcctgatccgactaatgccgatgcgcggccatttgttgggactaagcgccggacgattagtcatgtgattcaggtttaccgcgatgtgttaacgacgaatactgaccgtaatcgtgttggcgcaccattacaacctgctccggtgtgggtgtggttacggcaacaattgacgcgtgacccccaattcggtgagctagcacgtcaattgatggctggattaagctatcgcaatcaacctgtcaagctgacaccagccagcgttgaggctttgtatgggcatcaaatttatacgtcaatttcaaaactagaagaattttatcgtaatcagtacgcttatttcttgaaatatgggctcaaactgcgtgagcgtgatgtgttcgagttatcagctgctagtactggggagtttttccacgctgtcttagatgggctcatcaaggcgttacggtctgatcaaattccattggcccaagccagtgatcagcagttaggacagtatttagagactgtaacccgtcaaatattagatcaaccacagtttacaattttgacgagctctaaccggatggcttacttgcaacggcagttaatcaacacagtccggcagattgcatttgcgattcgcaatcaaagtaaactgtcagccgctgaaccgaagcaaaccgaggtcttatttggtaacgttggcaaggaacacggattaaaagcgctcgattttcaaattgatgcaacgcatagtgtgcacgtgcgagggaagattgaccgtctcgaccaaattcaagtggcagatcaaagttacctgggaatcgtcgattataagtcatcccaacataaatttgattttcaagaggcttactatggtctcgcaatgcaaatgttaacttatttggacgctgtgctgcataacgagcaagctttagtcggttctgatcaagctgcggttaaattagccggcgcactttacatgcacattcaaaatccaactctgaagccaaaagatattcagggcggttttgaagcagcgctcctaaagaagaataagtataagggaattttgctcgatgatccgcagctattggaacatttggatagcgaactacaacaaggtaacgggacctcgaaagtttacccattcgcacgtaaaaaggatgggtcgtatagtggggggcgtgcagcttcactggtgacgaatgaccagttagaacgattattacagcataatagtcaattgattattgcagctgctgaagcgattttcgctggagaaattcaactaaatccaattcggctgaacgataagacaactgctttacagtattcgccgtatctatcaattatgcagtttgatgcaatgttggccgaaaatgcttatcgggatctaccgccattatcagccaaacaggttcttgatttactgaagacacagaaaggtggagaaaaccatgagtgagggtacaaactatacacctagccagcaagctgttatcgcacagcagggaaataacttgttagtttcagcttcggctggttctggaaagacgaccgtattgatcgaacgtattatgcgcaagatattggccggcacgaatattgaccagttactcgtggtgacgtttacaaacttagctgccaagcatatgaaacaaaagctggaatcgcaaatcaataagcgaatctcacagttaatgacggacaatccggcgcaaaccacggcgtcaccagcgattcggcaattacggcagcaattaaatttgctcggggtagccaacattagtacgttggatgctttttgtctccgcgtgattcagcgttattactacgttattgatttggatcctgtttttcgcctattgacggacaacactgaggggttactcattcgtgatcaggtttgggacagtgttcgtgaacaattatatgatgaagatggtacgttatttgacttattaacagcgaatttttctaatgatcgaagtgatgatggtctcagtcgattgatttttcggttatttgattttgcccagtcgaccccggatccggaaggctggctgagcaagttaccggaaccttatcaggtggatgaggaagcgttaacggccagtgccttttatcaacaacaattattaccattgctcattaatgaagtcgatgggatgcaaatgaaattacggcaggcacaaaaagttgcgacggatgctgacttagtcccgaaaacgcttgaggtactcgctacagcacaaaaaatgctgacgacgctccgtgaacaattggcaacggcaagttggaatgagttacgtactcaagtcgctactttcaagattggagctctcaaaaaaacttataaggacgagccggagaagactgcgcgggccaaaactatgggcacatttgtggacggtgtcaagaaacaaatgaccacccttagcgagacctattttgcggccgatgagcagcaagtcttagatattatggtaggggcaaagtcaattgtgactgagctagtggatgcgaccaagcagtttaagacggcttttgcagctgaaaaacggcggcgacacgtcctggacttttcggatttggaacacctaacgttgcaaatcttaacgagtgacaatgaaagtggtcaggcagctttggcgcagttacgggcccaatttgaagaagttatggttgatgaatatcaagatattaactctttgcaagaaagtattttgcagctgttggcgcgcgaccagccaggaaatatgttcatggtgggagacgtcaaacagtcgatttaccagttccgattagctgatccgttattgtttttgcacaagtatcacgattttgggacgaatcccgaacacggggaacgaatcgtattagctgaaaacttccggtcggtggcgaatgtcgatcatttgactaacctaatctttagtcagctgatggacgcgccggtcgggcaaattgattatgatgaagcggcttacctcaagtatgggcccaaggattatccggccgatatgccacaaacgacgaatctattactttaccagacggaaactgacaagtcgacagaagatgtctccacggatgaaaccaatttttcaattgatgatcctgccgttgggagtatcacgatggtcgcccaaaagattttggcacttaaggcccaagataagccaatctatgaacgtgctaatggggaataccggccgtttcgttacagcgacgtggcgttactagtaccaacacgtaatcataatttaacaattattgatgttttcaaacggtatcacattcccgttgtggtcaatgatgcccagaattattttcaaaccactgagattcgaatcatgatggcactactcagtattatcgataatccatatcaagatattccgttagtggcggttctacgctcgccaattgtcggattagacgaaaatcaattagtttatttgcgtatccagaataaaacgagtgattattttcaagccgtccaggacttttatcatcattatccgactggtccggcgactgaatatggtgatcaagtttatgctaagatcgagaccttcttgacacaattgactgaatttcgagatctggcacgacgtaatcaaatcgtaaccctgatttggcaaatctatgaacgaactggctttttagactacgttggcggcatgccggctggtaaacagcgtcaggctaatctccacgctttatatgaacgtgcttatacgtatgaacagggcagttttaagggcttatttcagttcgttcgttttattcgccggatgcaggaaaaggatcaggacttggcagctgccgtggccgagactgatgcggaagcggtcaacgtaatgacgattcatggtagcaaggggcttgaataccccgtgatttttgtgatggatatggataagcagttcaatcagactgatacgcgctcaagcgcgctattggaccgagaagcggggattgggattacttatttggacccagaaacgcgtgtgaagtacccgaccttgccacaagttgtgactaagcaggtagtcagcaagaagatgcgcgctgaagagatgcggaaactatatgtcgcgatgacgcgagctcagcaacagctctatttggttggaacaatcaaggatattgataccgcgaccgaaaaatggcggcaggcctttgctagcgacgggcgcgtcttaagtgcccaagcacggattgcggcgactaatcaattagattgggtcggtatggccgtgatacggcatccggccatgaaggcatattggggagatgaatggcccaattacgaattgacggatgatccgaccaagctagccgttgaattgggagatgccaccaccgtcctggcggagcaaagtgaagcggtaacggatactcaacctgatgcgcttgaactagttgaacagcaagtcaccatcgatgttgatcaagtaacgcgtgattatctgaccacgttactgaattttcattatccacaccaggcttccacgacgacgacggcatatcaatcggtatcagaagtgaaacgaatctttgaagatccggatactccgctgatgaatgcgaacccgactgttagtcagcggcgttcacgaccgacatcccggtttgtgacagggtcactggagttaccacaatttttacaaactatgcaggcgccaaccagtgcggaagttgggagtgcgacccacttagttttagaacaacttgatttgaccaaaccggtcaatgaaacgacggttcaaagtacgattgatgggttagtggctaaccgggtcttaacgaccaatgtcgcgaaattgattgcagttgacaccatcgtggctttttaccagagtgcgctgggcagtcaaattttggataatccggcgaaggtgcaccgcgaagtgccattctcgttactgattccagcacgtcagattttcgatgttgatgaacatgagacgggaaaagttctgattcatggaattattgacggctatttagaaacggctgatgggttaaccttgtttgattataagacggaccacgtcaaacggcctgaagatttgaagacgcgctacgctggtcaagttaaactatatgcagcagcgctagcgtcgatgtatccaggaaaggtgactaaacagtatttgtactcactgccacaacaggtgtttgtgccagttaattaagtttggctgtcaggtggtgtttacaaaattggaaaaagcacgtcagaataatctggcgtgctttttgttgagtttggtcttaattaaagcgtttgtcatgtttaaagccaaatgccgcgtggctgacaaatattaggatagtagtaactgataagcattccgttgatcgttgttgtcatgattcatgtagacgataccacggtatttgaagccagctttggtaataatgtgttgcattcgcttgtttaacaagtgcgtatcaattcggagttgacgaaagccgagttggtaactcatggtaatgagattgctaaagtaaaagtcagtcagatgttgtccgtggtaaccattggcaatagcaatacggtgaatcgaggcatagcggtggttctcagtaggcgcccagctgccatcataaataatagcgtaattggggtcaggtgttgttagcagtgcagccgtcccagcaatctgatcatcgacaatgagtacccaggcaattctagcatcaatgtcagcctgaatatcagcagctaacgggtaaccatcttgccattggggaatctgatcggcagccaaggcgtgtttgccctgttcgataatagccatcatggctggtaagtcagcactagtagcttgacgaatatattttgacatgaattatcactactctcgtttagatgctcatattataagccaattttgtaaactggacaaatcaggaacagaatgatacttttttgtcctggtaagctttataatgaaacttaactaaaggacaggagtgacccagatgaaaatctttgtgattggtgcccatgggcagattggtaagaaaatcgtttccaagttagttgcccaaggtgaccaagtgtacgcgggtattcgccaaccagaacaggctgaggctttcgaggatgctggtgcgcagccagtacaattcaatttgatggctcagcctgaagatttagcgttggcttttaatggtatggatgccattgtttttgcagccggatcaggtggtcaaacgggttatgatatgactttaatgattgacttggatggggctgtcaaatcaatggtcgcagccaaaattgccggcgttaaacgctacgtaattattagtgctgaatttacaccggatcggagtcgttggccacgagcattacaaccgtactacgtggcaaagtattatgctgacgaatggttaaaaaacagaacccaattggattacaccattttacaaccaggtacgctgatcaatgatgccggtactggcaaagtaaccgttaaccctgacgttggcggtgagattacgcgtgatgatgtcgcaacttttacagttcaaacgctacacacccctgcaacggtcggtaaaaccattgcgttgatcaatggcgataccccaatctcaaaggctgttcaacaagcttaatctgaggttgagacgggttagcgaccatgataggttactaaaacttgtctgtttaatgacctgcatttggcgacctaacttgacgtacagtcgttataaaatccaccgtgtgagcttatcatattgataaacttacacggtggatttttaggtgctggttagtatgcgtgccaatcgacggattgaaaagcagcggtcagtcgttggatcaggtcggcttgggttggactaaacgtcattgagtggcggtacgcaacgccgacattgaacgtgggcgcttgtgcgtcagttagggggagccgctgtaatcccgctggtaattggacggcgttactcaataaggcaatgcccacatgctgacgaaccatgtttaagatactgccgatttcgttggattcaaagacaatcgttggccgaacatgattttgatgactgagttgacgaaacgcctggcggtggacaaagttatctttgagcgccacaaaatgctgatgacgcaacgatctgaactgaagttgtgagttggttgctagcggatcgtcagttggtacaacaatactaaatgactgggtgtcaaacgtcgtgagttgaatggtcgtatccgtgaattcattgaggtaagcaagtacggctaagtctaattgtccgttttttaatcctttgagcgccgcgagtgaaccttgactgataggttgaatctggctgaataaagcctgtggtaattgacttgcaatccggggaaagtagttgatttcaatgattggcggcatcccgatgacaagttgatcggttgtggtgtgggcaacttcttggcacatcagttggtgctctaataggatctgattggcgtgtcgttggacttgaatcccggtcgtggtgagtgccacgggtaagtggggattagcccgaattagtaattgtgttttcagttcggtctccaatcgccgaatagcagccgaaatggtcggttgactaacgtgaaattgggctgcaactaatgaaaaatttttcagctgagttaacgaaacataatattgcaaatctttaatattcatcttaaagtccttatttaattgatgcttaattgttagtattatgatttgttattataacatggttatttgactatggtaatcgttgtggctattgtagggctattaagagaaaagggaacgttgtacatgtttacgttcggagagttaatcgttattttagtcgttgttgggattgttgcgggtatcgttagcactgcagcggggttagcgtcgctggtttcgtacccggtcctactggcgctgggactgccgcccgttacggctaatgtcactaacaccgtgggtttagtctttactagctttggagccgtgccggcctcacgccgggaactacgggggcatggtcaggaattgaagacgctcatcccgctgactttagttgggagtattgttggggcaattctgttatttattatcccggcagcgacctttgcgaaggtcgtcccattttttattttgattgcgggaattttagtgctgattcctcgtcatattcatattaaacagcccggtgaaattgttgtgacacctaaatggatgacggctttagcttggttgggcatctttttagtcggagcttatacggggtattttggtgctgcgggtggtgtcttgatgttgtcgatcctgtctttcacgagtgccgcaccgttcgtcgtctataatgctcagaaaaatctggcgttgggtttagccaatattgtttcagccgttgtttatggcctacaaacgccaattcagtggcgctatgtattacctttaggcattggttttctaattggtggtagcttaggaccacgaattgtgcgccacttacctgccagattacttaaaattgtgattggaatcggggcattgggactggcagctagtttgtttaaatcggcttatggattgtgagtgaaaatgaagttagtggggacaaactcaatagcaatgttaaggctggtaaacttacttacgctacgatcttgaaattaagtcatcgggtctaaatcagtgtttgggctgatactatcaggcaaaactgcaggtaacctgaaatggggagggtttgacccggttggctgatccctgatgatgaaacaaaaaagactttcaagccgtgccttgaaagtcttttttgattatcccaatgagaactttaatcgtgatggcgtgaacgtgtccctaaaaagtaagcaccaacggctaacagaatcagtaagctgataatgcccaagccgccacccatccacataaagggcataccgccagtaaaagcccaaccgcacatcatggtcaccactttcctaattattttagtttcagtatacgcgcttttgccaggtactaccaaccgttctgcattattttaagctgttgagtagttgactttgttcattggtggttaacggtaaaattggtaggcgcgtgcttccgactaaccagtgttgggcgttcagcgccgctttgacgggtgccggtgagggttgtgtgaatagtgctgccatcttcggcattaaacgtcgttgaatttgccctgcttgggtgatatcgccgtggttcaaggcgcggcgcatcgtcgccatttcatttccaaataaatgactcgccactgaaatcgttccctgaccacccaagacgagggtggtcaagctctgagcatcttcgcccgtgtaaacgagaaaatctttaggcaccttttcaacaattgcggccaattcttcatcggaaccacattgtttgattccaataatgttggggttgtgggccaacgtcagaatagtcgtgaccgtcatcttaacgcctacgcgaccgggaatattataaattataatgggcaagtctgatttttcggcaatggctgtaaaatgcgccatcatcccggtttggttgggtttgttataaggcgggacaacgacgagggcggcgtcgatgccctcgatttgactgacaatgtgggtgaaatgaattgtggcggcagtgtcattggtccccgtattagcgatgattggaactcgcccagcaacgatcctagctgtctgcgtgtataaatctcgtttctcagcgatgctcaacgtggggccttcgccagtcgtgcccccgactaataagccgtccgtgccagttgcaagtaagtgttcgatcagttgctctaagcggtggaaatcaatgtgttgttggtcatcaaatggggtaaccatggcggtgatcaggtgtgcggatgctaaattcatgtggctaatcctcctgtgtggtagtttgggcgcgccataaggctaaacgatttagcccttcgcgtagtgccgattgactggctgcataacttatccggaaccaaccctcgccactcgtaccaaatgctgagccaggaacgacagcaacttgggcctcgtgtgcgagtcgggtcgcaaagtcccagctggtgccttggaaatcctgtggtagctggacaaagatatagaatgcgcccgtcggatagatataattgaatccaatttcactcagacgtttgacgacgtaatcgcggcgtgtttgatagacgtcacgcatttctgagccatcatccagaccatgggtaagtgcttcgataccagccgcttgggtgattgaactcgttgaagtaacgaggtactggtgggtcttcttcatctcggtaatcaagttacttggggccatgatgaatcctagtcgccaaccagtcatggcatgcgatttggagaggccattgattgtgatcgttttgcttggatatagtgtggcaaaagcagtatggggctgttcataggttagttcactgtaaatctcatcgctaataacgtagattccggcggtagcaatgacggcttgcaaagcccgtaattcatcatcagtgtacgtgacgccggtggggttggtcgggtagtttaaaattaaggccttgacgtggtcgcgacggtgatcatctagcgcagcttgtaacgcactgggtgttaatttataacccgttgcggttgtgtcaatgggagctaattgtgcgtttgcgatgtcaacgacgggttgatagctcgtgtaagccggtgttggcaataagacggtatcgccaggattaagtaaagtgagcagggtcgttgccacggcttcactagcgccgactgttgcaatgatttgctcaggtgcataggtgagttggtatttctgttgaaagtagtgactcgcagcatcttgcaaagcggcaaatcccattagtggcgagtagtgtgtccaatcattatgaatagcttgaattgccgctttttttacgtgacttggggtgggtaagtcaggttcgccgaccgttaatctgataatatcgggaatttgactgattgcttcatcgaagcgtcggatgccagagacttgaatttgttggatccgaatatttgtattcatcattaggaccttcctctcaacgtgattaccgtttataataaacaacaatcgtccggttagaaatagacaattttgataaaaatgaaaggacagttgtgtgatgccattaaatcgtcagtcaacgacaccgttatatattcagttataccagcagatgcgtgatgactatgatgctactcaagccaaccaccagttatggtcaattcgtaaaatggcacaaaatttgggagtttccaagaccactgtcgaacaagcttacgatcagttgctagcagagggctatgtttataccgttcccgggagtggctacttttatcgcgatcggacacactggccagcagctaaacaggcgctggagactgtgccacagcccactaaacccagggcgttcacttatgattttcggtatggtgtgactcagttgttatcgccaagttggaacgcttggaaacgggctgtccgactagcgttgcgtcagactgagcagcaaccaacggccgtttatccggatgcgcagggcttaccggctttacgtgaaaacttggttcgatttttgaaaacgactcgtggtgtgcggtgcacagcggaccagattgtcataacgagtggggctaaggcaggtctcagtattctacttagtatcttgccacgcggaacggtcgggattgagaatccgggctaccgcggtttatccgaattggcggctagttatggacagatggcggtccccatcagagtgacggaagatgggctcgatttgacacaagttcgtgagcgtaatcctcagatcatttatacgacccccggccatcaatttccattaggagtcgtcttgcccatcgagaaacgattagcgttgttacaatgggcggggactcagcatctcatcattgaggatgattatgatagtgaataccgctacagtgcgcacccattacccgcgctacagtcactagcaacggccaaccaggtggcttatttggggacattttcgcggggcattgatccgacattacggatgggatatttggtcttaccaccacaactggtggcaacttatcatcaacagtatcaatatcgggctgaaatggtggccggcctgttacaacaagcaatggctaattattttgaagatggggcgtattatcggcaccttagtcgaaaccgagctgctaatcgacaaaagtatcgggtactttgtcaacagttagcgcaaactaagcggatccggccaattgcaaccggcgcgggggtacacttagttgttcagattccaggcattgcacaggctaaattattagaagccctagaacagcaacaggttcggatttatccgcttaactccaattggcgcgacatgcccacgacggattattacttgttagggtttgccgggctgacactgtcagagttgacgaccggtgtcaaacggttggttcaagtttgtgaacaactggtagggtaggcgtttataagcggaacgggtggtgttagggattattgcggcgctagtcaagctaatccgcaggcgcaatcccgaaggtcaaaataaacgtgtattgccgacgggcagcaacccattcaattgttaaagcgatataaaaaggaccagttatcaacacgttgttaggcaagtgttggtaactggtcctttttattaaaccatttaagtgactacgttagggcgactagttgcggtagacccagcggtggccgtctttacgtaataattcatcggccgcatctggtcccattgtaccagggcggtagtttggaaattcgggttgatgttcatcccagtatttttgaatgacgtcaacaaatttccacgaatcggcaacctcttgccagtgggtaaagttggttgcgtcgccatttaaggcatcgtgaagcaaacgttcgtaagcttctgggctaccagccgtggcttcagcatcgtgagaataattcaacttgaccggggtggttgcgaagccttggccgatggctttagcattcatgcggagctcgaagccttcagtcggttcaacgttgattgtcaagatgtttggatcgagactggttgctgcgtcgtcattagctcggacgtcttcatgattgaagatattgacgactggccgtttgaacaccacgtcgattcgcgtgaacttatcggctaagcgtttcccagtccggatgtaaaacggcactccggaccaccgataattatcgatcatgactttaccagcgacgaaagtatcggtgttagaatccggtgaaatcttatcttcgtcgcggtaagctttagcatcatcgcctgcaccgtattgaccacggacaaagttggttgcgacttcttctggtttaagtggccgtaagctccgtaaagccttgaccttttccacgtcgatatcattttcagtgaattcaactggttgatccattgttaacagactcaaaatttgcaaaatgtgattttggaccatatcccgcaaagcaccgctgttatcatagtaaacggcccgttcttcgacacccagtttttcacttaacgtaatctggacattgtcgatgtaacggttgttccataatgattcccaaatattattgccaaaacgaatggccgtgatattttgaatcatttccttaccaaggtagtggtcaattcgataaatctgattttcgttaaaagtagccgttaattggtcgttaagttccttggcactttcataatcatgaccaaaaggtttttcgataatgacgcggttaaaaccgttatctgtcagaatattttcggaacgtaagtgttgggcaatcgtaccaaagaagtttggtgccattgctaagtagaagatccggttgccttgtaaaccatattgggcgtccagcttttctgataattttttcaaagttcggtaatgttcagcatcagtaacgtcatgcgattgataataaaaatggctcgcaaattgcgtcaccgtttcctgatcagcattcagatcagctagggagtcactaataacttcatgatagtgatcatcagtccaaggacgccgagccgtcccaataacggcaaagtggtccttgagatagcccttttgatagagcttaaatagtgacgggtacagtttacgctgtgcgaggtcaccagtaccgccaaagatggtgaataaggcaattttttcgttactcatcaatttcacttctttactaagaatattttaaaccaagtacttgttcataagcattaattcagattaaactaccgtattaatattaaaccatacgtggtgatggtcaattataaagtactaatgttgcggagattttgggaactggtgtttcagttcacgctcagttgcaacgttttgcatgatcaaaccaaccgctaaggcgatggcttgaaaattaaagctttgcaatagcggaatcttgaacagaccaccaataatcgcgccgattaacaaaatggaaaagatttcgatgccaaacattgaatagaagcgttgtgcgaaccgccatgtttcctcattttcaatcgcgcgtcgcgacatgtagccagcgagtgagcgcatcttaggcattcgcacgcgttgatagatccagagcaacagaatcactaggaagcctaacgctaggccaaagctattattcgccatgttgtcacctcaattgttgaaagattacaccggttggcagtgtttagttatattataacaatcatcgggggcggtagtcgacaatcaggttcaaaaaccggatatttcaatattaatttttacggattatcgaattaattttggcaagctcggtcgagtcggtcaaaatcgccggggagtcgaaacagttgtgactagtctttaaggaaatctcgatggggactttgaagatatccaggggctatcggctgggggtggcttgactgaccgcacactaaccctggttgtcactggtttttagtttagcggtcgcacgaaatgcaaatgagctttcagcatgcgagctgcatgctaaaagctcatttgtaccgctggacgagtcccccgaagatccgcacatggttatcgagtatcaggattggttaatccgtcacgtgaatgacgattttacccgtcgtatggcgactttcgatggatcgatgacccttaatgacattggctacggagaacggtaatgtcgcaacggttagcttcacttgaccgctgacaactaattgggctaagtcggctaggtcttgtgatgagccttgggtgaactgaaaggcaacttttttctgttgatcatgttgctgctcgtccgtcggttggccggcaatggttgcgagctggccgtcagcttttagaaccttgagaccagtatcaatatcaccaacggtgtcaaaaacggcatcatagtcgtgcaagacggcggcaggatcggtttcgtggtaatcaatgacttcatcggcccctaggcgagttaacaagtcacggtgattagcactagcggtggtcgcgacgtaagcgccaaaggctttagcaatttgaattgcaaagaggccaacaccaccagctccaccctgcaccagaatcttctgtccggattgcagcttaagattgtgcttcatgccgtaataagcggttagtccagcgattggcaaagcagcagcttgatcaaatgataagcctgctgggagatgggctaattctttagtattaacagtaataaattcaccataagtgccgttattagctgcgtgggcaggcgcggcggaaccaaacacagcgtcatcgatgttaaaaccagtgacggccttgcccattttggtaatgacaccagcgaaatcccaacctaagaccaatggaaaggcccataagtcagtaaaaggtgaggatagggctcccatccggccagcaatatccatgggattgagactaaaggcgtgaatcgcaacttgaacttcatcagcttgtggttcggtcgtgggcatgtcgaccatcgtaaattcatctgcggaaccgtattggttaatagcaattgttttcataatatcgtaaccttctttgattaagtgtgccgttagtataaactatggtgtccacacgatagcaagtaaaaagtaaaaaagttggttaatgatttggagaagcttcaaagtaagcaatcttatgtgctaaaaactgatcagttgcctgtaattgagcgatttgttttttcacagtagcacgatatgagctcagttcttggattcgctgggcccggtttggaatgtggccgtcaccgctgagtagttttagatcaaggcctaattgccgaaaagtggcaacgaattgtagacgctctaaattttgacgtgaatactgtcggtagttgttgtggttgcgtggtacgggcccaatcaaccgttgttgttcataataacggagggcgtccttggtcataccggtgatggcgacaacctctttggtactaaatgccgtttgttcagctggaatggtgaaaagtctcatgtcaattgctcctttttgactttagtatacacgtggtcagtgcttctcggaacaatactaaaacggatgaaacggatccgcggagtgggggccgcatttagaatgcaccaaatggtcaaagcacgggcctaggctgcgactacagcgttgcgattgtaaacaacatgcagtgtaagacttgatgctaagcgcggcttaagtaaaaatgatttcgtagactactcagcaccttttgcgacctgattggtaggtaaaaacggtcaggcggcgtatactatttagggtattgttttctcaatgaataaacttaaatcaggaatgtggtgaggagatgcaaaaagaagttcggttacggtggctgtttctagccaatttgctgaataatgcgggtgccgcttttatgtggccattaacaacggtctacatgcataattatctcaaacaaagcttgacgttttcaggagttattctttttttaatgtcgttggctatgattgctggtaactttattggcgggcgcttgtttgatcactggcgaccatattatacagcgctacttggtggtggtatttcgaccgcaattttaacaacgttgattttctggcatagtttgtggccttacgcgattggcttgatcattgtcggctttggtgatggtatcagcatgacagtcgtcaatgcctatgccgcaacggtaacgactagatccaaccggtatgtttttaacatgctttatttagcactcaacgttggggtcgttattgggacattattggtcggttacttattggaactaggtatcaatgtggtgtttatggtggcaacagtttgctaccttggccttatgacgattacgctcagcacctttaacgtcacaccgactgttcggacagagaaagctgcgccgcagaagcgggatgtgacgcctgaaaatcaccgtcaattaatctggatgatctgtttgatgattttcaccatttatttgagttatgccttatgggaaagtattctttccgtgcacatgaccaacttggggattccgttccgccggtatagtgaagtttggacgattaacgggttgttgattattgtgagtcagccgatcgtggcgttattcaacgaacgatttaagattggcactcagattggcttgggcattacgctatttgccttatcattcttgggattagtatttgcccggcaatacgtcgattttattattatcatggtggtgttaacgatcggggaggtcattggcttaccgattgcccccgcctgggtcgatgatatggcggctgatgatcagcgtggaaaatatcaaggccgatacaacatggctttgtcattggggcgagccgtggggccgttgttcggtggcatgatggtggctcagttctcctactcgttattgtttattacggtgactatcttaatgttaggtagtttggcgttagtcttgtggcgcgcccggcgagaacacttattaaatggttaaggagcaggtgggccccgtgatactaacaaagcttttaaggtcaaatgccttgaaagcttttttgattctgtgaaagtgatgatggagacgattgacgatacaatttgcgcattatcggatagaataaatgaattaattaataaaatgaggtgagtacgtgaatttgatggtttccagctttattctggtgttggctgcggttgttagtatttttatttcccgggtaatgccgcaaatatctgtgaactacttgagtctgatcgtcggtattggcttgttttttattccagttttgagcaatcatattgaaaacttcaattctgaaatctttattggcctgattgttgcgccactcctgttttttgaaggacaagccacccgactgaatgccgttggtaaggaattaaagcacattatccaaacgaccgttggactagtcattcttgccttaattgtcgcgggatttagcttggcggggctgggattagtcggcttgccgttagcttttattctagcggccatcagtacaccgaccgacgccacggcaatggaatcggtgacgaacggtttggagatgccatcaactgagggaacttttttaaaaatggagtcgttgtttaatgatgcttctggcatcatcttattgaacatggcggttctctggtatgctaatggctatattaactatgggcaaacgattattgattttattatttcagctgtgggtggggtactctttggttttgtcagtgcctggatcatggttctgtttcggcaagtattgttacgctcttcgtataattcgttgaatgcgtcgctgttgatgtacgtgattacgccctttattttgtattatgctgctgaggcgattcacgtttctggaatcattacggttgtggttgcgggattagtgcataatgcggaagcccaacgaagccggttaattaatgcacaacaagttcattttgcttttgacttggtgagcatgattactgaaatctttaatagcatggtgtttgtggttcttggattcatgtttatcaaaattcttgttaacgaacaattcgggcatgggtccttgaactttttgttgattgggcttgttctgtatattagcaatgtgctggtgcgttacagctacggtcggttgcggttgagcttcaagaatcggcccgcatggatttttgcgttaggtggcgtgcacggtgcggtaacgctggccttagcctatacgttaaccgatactgcggtcggacgtggtgactttaacttggttctaatggctgctagtacgttgattattctgagtatggtcgtgccgacgattatttttcgctggttgctaaagccggcgttgactgatgatgaggcaactagtgagattgatcagattcgggtggcgatggttcaccacgcgattgatacagttcagaaaatgtatttgccgtcgaatgtgaaagaatccgtcatttttgatttgatgacccagaaacaacggactaggactcgtgattttgcgcgtgcctgggttgacgttgttcggcgtccggaatttactggtgcagaaaaagaattagagatgcgggcatttatgaatgcacttgaacaagaacggcaatatttggatatgatttcacaacgagaggtcaagtatcagaagtacgtttttaaattgtacaatgaaaccttattagcggaatcactagtcatcggccccacgatatttgataaggataaggcaacggaatagcgtgaaatcgtcgttactgaggcgattggtcaacttcgtgctgtgaaaacaatcaaggtccaagttagcgaaaactaacttggaccttgattgtttggttaattcgattaaaaggtttgattgtctaaataggcggccaaacggtctttcatcacgttatagacgcgttcagtatcaacggcagtcccgcgaagctcataatccgcaatcatgtccgtgtcaagttgttcagcataacgccgagcggttagacagtactgatcgttaaagttacggttaccagaaccaacaactccgagacagaaccgtgagttttgatcgtagttaagatattcacctaacacgttggtcatcaattccttaaccccattgtcaatgccgttaccaccgtcaaggtaggttgggacaaaggcgaagtagggttcagtctcaatggcaaagtctgactgttcggtgatttcttttaaggtaattaatgggttgttatcatcagctgcatgctgggtcttggcgtaatcctgcataccggtgacaaatgagcgggtattgccttcaatggagatataaatgatattgattgttgattcactcacagcagttcctcatttctgttttacattagttttagtttacgctgggcactacttaattgcaaacgactacggctccgaatcgtcgcagtttgttgtgataacggccggcttaagataaacttaatttttagtaggctttcccttaaatcaaccgcatccaatttatgtacaacgggttagtggcaattcacacgacttatcatataaaagtaccaaagttaaccagttgaagttcgccggatacaaaaaaatggcctctaagaaatcaactttcttaagtgccattttaagtagtgcgtgtaaatatttagtcttgtgtttgatcgtcattatgatcgtcaggtgtgctatccgtctgggcgctaacctcaaaccaattgatataagcattttcaaaatcaagcgctttgaaattgaagttaccgatttgaatcgtatcaccggcttggattttaggaaaattatccaaaatataaccggtcaaagtgacaacatcggaatcttcaaattcttgtaagtcggtcttgaagtagcgttcaaagtcgtagatggtcatcttaccactgatgcggtaagtgccatcggcctgcttttcgatgtattcgttagaaacattgtcgatttcgtcattgacggttccgaaaagttcttcgtaaatatccttatcagtgacgatcccactggtcccaccatattcatcaaccacgacgacgatcggcgtttgtttgtcgatcatcttttggagaatggcttgaatcggtgtagtttcaggaattgtaatgatattacgcaataacttattgacccgaatatcatcgtcaacttcaccttggcgaattaagtcatagttataaacgtaacccagaatcttgtccttatcattgttagctacgacgggtaagcggctaaagcgtttctgtaaataaacgcgaatggcttgcttgacggtatcgttgatatcaatcacaactagctgagtacggtcaatcatgatatccttagcgatcttgtcattgaactcaaatgcccgctccatgtaaaggtaatcgttacgttcaagctcaccgccagttacggcatttcgtgataggttaagaatttcggcttgtgaataaacatcgttatcctcattcgcaactgggatgcctaacattttgacgacgccagctgatgagacattcaacaaccatacaaaggggtagaacatcacgtggaaccaccgtaatggtgtcgtaatgaccgccattactttgagtggcatgtcgattgcgatatttttaggcacgatttcggttaagaccacttctaagtaggtcagtaggaaaaccccaatgacgatactaatacctcgtaataccgcggttgagacggataggttgaagagggataagaaatcaagcacaaagtgttcagttgtttgttcaccaatccaacctaaaatgataccagctaacgagacccccacttgggtggttgaaagatactcgttaaggttgcggaccatgtgcaaagaagttgcgatccgttttgacggtttatcacgttttttttgttcttcttcgagagcgctagggcgggtctgaacgagtgcaaactcacaggccacaaagaaagccgcgacgaagaacgtaatgacaataatgactaaatttaaaattatctggccactgtccaaagaaacattcctcatttcataaatattagttactttaagtataacgcgaagtagctaatattataaggcctatcacccgttttgtcagcccccgtgacggttaattaattggtctatcgtagtcagcgggcctactggcaatcttttaagcgccaataatgcgatcgcgagaaagatggttaacgtttccaatgaatggtgctaaactaagggtataccaagtaaagggagatctttaatgatgccagtagaaacgaaaactaagattcatgaggattcgaagaaattggtttatcaagatagtgatgtcaaaaaagcgatggatttaatttgtgaccgtggttacgtgacccgtgcagatttcaatcagatggacgatgcggattgggcggccggttttgatcaaaagattgaagccgctttcctaaaagttgaaggcgaagacccgtacatctacttcgaacaatttgatttcaagggtggcgacattgattcaatcatctttgatatggatcaagttggcacgcgtgaccatgccttagatttacttgctgaagccattcaccaacaggcttactaagaattgatttgatacggaggttattgacatgcgccagcaattattcggtcatcatttggatgatctactaaagcccaccaaattattgaagcgggctcaccgggaagcagagaacgtcttaaacgcacacgttgggatgaaaacggacgtggttgaacatgacgatgattacaccgtgacggcagaattacccggttttgataaggaagctattacggtgaagtatgctgacgaatggctaactattcgggcgcaccggtcgcaagacgatcgcaacgatgacgggcgcgtactccatcgcgaacggatggacgcggactttacccggaagtttcatctaacgaatgtcgtgcgcgaagagattcaagcgcattatcaagcaggactgctgaccgtgacgttgccaaaaaccgttgcggatagcgaaggtaagatagaaatacaataaataaaagcatcgtcagcgaactctgacggtgcttttattcggtacatacacattgatggcaacggatttttttgcacacttaggggtgttgttagcaaggtgctgtctcaactagttgacagagctagcaatcagtcgtgacaacctaatgagcacgaatctgaaagtctgtagcataatcagatacaaattcggggtagtcagtgaatatcggtcaccacctgagcagcttattagcaatcatgatgtgatttaaagtgcgagcctacttttgctcatcagtcgcatcgccattggtgtcttcagctttattagcatccgagatgctcatttgaatcgtacggggacggtctttgataataacaatcgtcccatggccgaggaagtctttgggcccatcataggccatttcatattcattggcgaatgagccggatttttgaagtgtcatgaagaaaattttattgtcttcgtagtcgtcactgaacatgatggccatcgtgctatcaatcaataatttctctttgcgcatcactttgagacggtcccaaagtccggcaatcactgcttgtggaatcaattctttaacatcatcaccgacacggagctttttggtcatttcatacataccgcataacctacttttcatttgtatttgcattaacccataaatgataccatattcagaaattaatgtgatttacaatgtcatctagtttacaagactagttaatctaggtataattaatgtaacctatttatcagaggaggacgcagcatggcagctaatgagacttatgcagattggcaggcccgcatggcaaaggtgattctgccgaagtggatcgagttaccgaactttgacttatatatggatcaggtcctattattaattaatgaaacgttgcagccattaggtgctgatccagttactgccgcaatgatcaataattatgtcaaacataaagtgatcttgtcaccagtcaagaagaaatatcaaattatgcaattggcggatattattgtcattagtttactaaaaccgagttatccactggataaaattcgtcagggaatcgaccaagtgactgcgactggctatcccaagcgagcttacgacaattttattacggtattaacgaatcaacttcatcatcccgatgatccacttacgatttctgatcaggatctcagtcacagtttaacaaccgcagcggctcagctgattgttaacaaattacgcacggatgaattattgcgacttaatcaagtacagaccaagccacaacaaattgaaaaataagctgaatacggtggaccaagtaatgtcagttatttggtccatacgtgtttttttggttgctggaatggcggggctttagtatcatataaaatgattgtaagcaatttaaattgggatagagtggatcaacagtggtttgtttgttaatctgctttacattgggaagagtgattgatatgaaggtgtttatcagtgacgatcaagaacaacagcgtctctggttaaacgacatcattacggcacagctggaggcattgcactttaattatgagttagtctcagtatggcagccgaccgatgtgttagcggcggtaaaagatggcggcggaccaaatctttattttttagatatcgttttacaacgcgaaatcaatggcattcaattggcctctaagattcgtgattatgatcctgatgggtttattgtctatgtgacggtgcgtgatgacatgattccggatacgttgagtgcgatgacaacaccaaccgggtttatttcaaaaacaaatatgttcgataaagcaaagtttgttccagaagtacaaagagtcctacaagtcgtaaaaaaacggttaggtatgttacagcaatctgctgaaccgactttaacgattcgaagtggtgcgttattattaacgctgaagcttaaagatatcatctactgtgagaaggaacatgggctgcggaccacgcgaatcgtgacgacgacccagtcctatgtcgtgcataagaatttaaatacgattaaggaacaactgacagcgatgcatttttttaatgagtttcaaagttatgccctcaaccttgaccatgtgattacggttgattttaataagggcgtgattagtatggacaatcatgatcacttgacctttagccggggaacgatcaagaagttacgggcgtactaccagacccagggataggatgagtgtatgataactgaaacacaattaacagcaattcaaacgtatgctttgcaaaagcttgctcacgatcatagtgggcatggtcgcgatcatttgcagcgggtcaaccggctagcacgccggctggcaaaagccgaaggggcgaatttaaatctgactttagcggcagcttggcttcatgatgtgatcgacgataaattgatggccgacccagcgaaggcgcatcaagatttgattgatcaattgaacgcgcaaaatgttacggctgccgatcaaacggctatttttgcaattattgatcacatgtcattcagcaaatccttcaatggcgctcaaaaattaagtcttgaagggcaagtcgttcaggatgcggatcggttagacgcgattggcgctatcgggatcgcccgggcgttgtattattcaggtcatgtcggtgaaaaaatctatgacccggcaattgcgccacgtgaacatatgacgcgtgaacaatatcgacaccagcccggcacggctatcaatcacttctatgaaaagttgttcaagttagcagctctcatgaatacggatactgccaaagcactggcagcccaccggacagcggtgatgcacgagtttgttgatcaatttaaggctgagtggacggcggatgataaggcgtaatggcatccctacgtctagttgaatcactagttctttgagctgagatcatgttatcagatgatgcaattaccatttatattggctaacgaaaaaggccatcacaagaatgtatcgtgaattcttgtgatggcctttttagcccttattctggttttaaggctggcaatctaaatcaggcacggttggtcagaagatgggttaccaacatgactagtagggacacgagtagtgagtagcccaagataatggcgaccattagtccccaagtaactaacgtatggatccaaccggtgataccgatgaacgttagtaaggtagtcagcacgataatgatgacgatggtgctatacaacccgatcgcactattctgatagtcagcgggacttagatcgaagccaccaatcacaatgacgagggttagaaagagcaacattaatagttgccaccaactcgttggcgtactggttaacgcgtgaaaacttgcagcccattgcggttgttcgggtgtatcagctaatttgaagatggcttgaaataggccaggagcgagtagccagtctagtccaaggagtgccgctgtgcatccgaagatgggggcgacaccaatgaacaggttaccaatgacttgataccggctgtgccgattccaagtatggttaacatagcctagtgccagatcatccgccgactcatcttcaggatggaggtgagggcgtttgagcagccggaccgattggatgccgtggcgaaaaatcagtgcgaggattagatggctaagctcgtggatgatgatgcccagaaaaccacagtagacctgactgttaataccgtagtggttgaccagatttgctttggtttgtcggttgataatcgtcagtaaccaagcgaatagtcctggtaaaccaatgatgaccagcaagacgatgccgttattcttgatcaagttatccacgaggctactccgttattggaccaaaagtgccgtgcacgagcttgcgtagatcatcagcgtcgatttcaattgaacgtccgattttacccgaagatacgagaatcttaccttgctgcttagcggtctcgtctaagtagatgggaaacttcttagtttcccaaataccaactggtgtgttggcgccgtgttggtatccggtagtccgttccaagtcctttaatggaatcatgccaacttttttgttgccggatagcttagccaattttttatagctgaggtgctcatctaacggcaagacgccgacgacgggaccggtcttgttaccaatcagcgctaaggtcttgtagatatgatgttcgtcaacaccgaggtggtcgacttgtaattgttgaacgtcgccttccgtttcggttgggaattcatattgttgatagctgatatttgctttatccaaaatcttttcaacaagtgttttacctaattgatcttttttcttcttttttgacattattgttaacctcacatttattaaaaatacggtccaattttataaatggaccggaacaattcacccaaacgccattaattctgctatacttgaggtatgaaataacctcaaaggagggattacaatggctgacctagtttatcaacaagtcatcaatgatctcaataaacggatcatggcgaatgaatttgttgataagaagcttccagatgaacgtagtcttagcgaacagtatcaggtaagtcgtagctcgattaagcgcgcgcttaacgtgctagccaataagggcctgattttcaagaagcggggttcgggaacgttcattaatccattatatcttaaaaatcaatcttcgtttaagtatgaaggaactaacctaggaattacggacagtttaaatactgagggtgctaagcccagtattcaattattagactttcgcgtcattcctgcaagtcaagagttgcaacaagacttatttttaactgctgacgagtttgtttatgaaatcaaacggctgcgattactggatgaccagcctttcatgattgaaagtggctatattccaatcaagcttgtgccccagttgaaccgacaagtggtcagtggatcgatctttaattacgtgcaaaagaccttgcacgccgcagtgaccaaatcattcttatcgattgcggccgatgcgtccaatacgactgatcaagagttgctacatttgcagccgaatgaaccggtgggcctgatgagtgggatcttctttttagatgatgggacaccctttgaagtgtctaatatgcgattacattatcaatatatgaagtatacaacgtttgtgtcaacgaatagttaggagtctgaggtgtcatggcactgattcgtattaattttatggcggctagtttacaccggaccgttcccctgatggtgtgtttaccaacggataaattggtcccagatgagcagggcgtgccgcgcccgattcagggtccgtttgccaccctgtacttattgcacggtatcttaggtagtgaagtcgactggattagtggcacacgaatccagcgctgggccgacgaacggaacctggctgtcgtgatgccagcgggcgagaatagtttctatactgatcatccttggtctggggagacgtatagtcaatttattggtcaggaattgattgattttacacgccggacgtttccactatcacaccagcgtgaccaaacttttattggcggattatcaatgggtggttacggggcgctgtataacggactaaaatttcacgatacttttggggccattgtgagtttatcagccggactgaatgtgcgacccggaatggaaaagttaccggcaaaacctcagtggtttgcggaaacggccgcatatcagcatggcgtttttggcccagatctagcagctgctggtcattcggaattaaacccgcaagtgctcgtaactaaattactggcagctcacgtcgctttacccgcgatttttatggcgattggcgatcaggacggcttaaagccagcgaatgatgaatttgatcattttctaacggccaaaaaagtttcgcatgaatatgtggtcggttctggagcgcacgagtgggatttctgggaccgctatctattaaaagcactgaactggttgccactaactaatcagggcgccgatgttaattctgggcatattaaagctaattgatgggctgcttcaatcattctgtgtacaaattattaaaaaatatattaatctaaaagcaaggtgtcccaagggatgagccttgtttttttgttttaatttataaaattggaccgttccaattaacaaaaaggttgattttttgaaatgagttgttaaaatagaacttgtaaacgaaaacatttaaacagttagcgttcaagtgaaaagcaaattaaggagtgtttttgaaatgacaacagattactcatcaccagcatatttgcaaaaagttgataagtactggcgtgctgccaactacttatcagttggtcaactttatttaaaagataatccactattacaacggccattgaaggccagtgacgttaaggttcatccaattggtcactgggggacgattgccggtcaaaactttatctatgcccatcttaaccgggtcatcaacaagtacggtttgaagatgttctacgttgaaggtccaggtcatggtggtcaagtgatggtttcaaactcttaccttgacggtacttacaccgatatttatccagaaattacgcaggatgttgaagggatgcaaaagctctttaagcaattctcattcccaggtggggttgcttcccatgcggcacctgaaacacccggttcaatccatgaaggtggcgaacttggttactcaatttcacacggggttggggcaattcttgacaatcctgacgaaatcgccgcggttgttgttggtgatggggaatccgaaacgggtccattagcagcttcatggcaatcaacgaagttcattaacccaatcaacgacggggctgttttaccaatcttgaacttaaatggttttaagatttctaacccaacgatttttggtcggacttctgatgctaagattaaggaatacttcgaaagcatgaattgggaaccaatcttcgttgaaggtgacgatcctgaaaaggtccacccagccttagctaaggccatggatgaagccgttgaaaagatcaaggcaatccagaagcatgctcgcgaaaatgacgatgcgacattgccagtatggccaatgatcgtcttccgcgcacctaagggctggactggtccgaagtcatgggacggtgataagatcgaaggttcattccgtgctcatcaaattccgattcctgttgatcaaaatgacatggaacatgcggatgctttagttgattggctcgaatcatatcaaccaaaagaactcttcaatgaagatggctctttgaaggatgatattaaagaaattattcctactggggacagtcggatggctgctaacccaatcaccaatggtggggtcgatccgaaagccttgaacttaccaaacttccgtgattatgcggtcgatacgtccaaagaaggcgcgaatgttaagcaagatatgatcgtttggtcagactatttgcgggatgtcatcaagaagaatcctgataacttccggttgttcggacctgatgaaaccatgtctaaccgcttatatggtgtcttcgaaaccactaatcgtcaatggatggaagacattcatccagatagtgaccaatatgaagcaccagctggccgggtcttagatgctcagttatctgaacaccaagctgaaggttggttagaaggttacgtcttaactggacgtcatgggttatttgccagttatgaagccttcctacgcgttgtggactcaatgttgacgcaacacttcaagtggttacgtaaagccaatgaacttgattggcgtaaaaagtacccatcacttaacattatcgcggcttcaactgtattccaacaagaccataatggttacacccaccaagatccgggtgcattaactcatttggccgaaaagaaaccagaatacattcgcgaatatttaccagccgatgccaacacgttattagctgtcggtgacgtcattttccggagccaagaaaagatcaactacgtggttacgtcaaaacacccacgtcaacaatggttcagcattgaagaagctaagcaattagttgacaatggtcttggtatcattgattgggcaagtacggaccaaggtagcgaaccagacattgtctttgcagctgctgggacggaaccaacgcttgaaacgttggctgccatccaattactacacgacagtttcccagagatgaagattcgtttcgtgaacgtggtcgacatcttgaagttacgtagtcctgaaaaggatccacggggcttgtcggatgctgagtttgaccattactttactaaggacaaaccagtggtctttgctttccacggttacgaagacttagttcgtgacatcttctttgatcgtcacaaccataacttatacgtccacggttaccgtgaaaatggtgatattaccacaccattcgacgtacgggtcatgaaccagatggaccgcttcgacttagctaagacggctatcgcggcgcaaccagcaatggaaaacaccggtgcggccttcgttcaatccatggataatatgcttgctaaacacaatgcctatatccgggatgctgggaccgacttgccagaagttaatgattggcaatggaagggtttaaaataagcagttaaaatcttaatttgaaaatagcgttgctactggcctgtgcctccagtagcaacgctatttttgtgcgctattaattgtgtcgattggatactgtcaactcagcatgggcgacttatttcagattgcgtgtatatcaagcaatactagtggtatgtcaacaagtactgattggtgctggaatgtagcctatgacgtcttaatcagaacctagctaactgacgtttaatcaagaagcaacttgcaatgactagcataatgtgaattgtgagcatattttaattggtttttaattattcctgttataataacgctacctaagctgatactagtgatggtgattagttaaggatgaacgggtctgacgcaatcagctcagcctaacatcgtcgattccggttccatgaaccgagtttatgtggaaaggagcgactggttgtttaatcgccagtcaacgatgctaatgaaaattttgataacagtcgagaatttagtgatggatggtgtcaaacgagcggcgacggtcctcggtaatgcgttgacctcgcaagccgaggttgctttttactccttggcccaaccccggtctttttatgaactgagcgcaccgcttatcacggcgcgccggcctgcaagtgcgacggtacttaattactttggcgctgatccgttgaccgtttatgcgcctcaaatagatgatttactcacgacgattgggtcgggagcttacgatgccgttattctcccgggaggcttactgacgagttttgctccggcaatcaaacagcgttttccacgggtcaatgtcattgcgtggatgcacaataatgttgatatctacctcaatcagtattatgtccaaatgcaagatgaactggtcgcagggctcttagcggctgatacggtcgtgacattgaccgattatgattgggaaggctactcacgttttaacgcccatacggtcaagttttataatccaccgaccatgcaagctcatggtcagcaggccgacttggcgcaacatatcattgcctacactggtcgtattgacctgcaacataaggggctcgattatttgttgacagttgcgcgagccttgcccaatgattggcaaattgcagtcgcggggactggtcccgaagaccaattagcgacgttcaatcggttgatggctgaactcgatgttcgtgaccgcattatttatcggggtgcgctgaaagatactgagttacgggcgcattatcaacaggcgagtgtcttcatgatgacttcgcgttgggaagggatgccattagttatgggggaagcgatgacgatggggttaccgatcgtctcaatgtggaatactggctcagccgagtacttgcagggtggccagtacggtgtgttgactccggcccgcgatgttaatgctctgattactggcttaatgccactgttaactgattttgaatgtcgcgctgaatatgccgcgcgcgctcggcaacgcagtcatgactttaccttgagcaagatcgtccggcagtggctggcactattgaatcgccaatatgttccgcaaacggtcgtcgaatcaaattggcctgcggatttgagtagtgggggacattagcctgtcatagcggtcatgataatcgctcagtacttaggacctgaatggtcggtgctgagcttttttgtcattgatggtggggattttcttttgatagaactattatataaaagttatgaattctattaattaatttgcaaacgcgtgatgactttgatacactcaatcaaaaggtcagccgtgcctgaccgcattggaggagcttgctattgaagacaacgtggctggctagtttactagtcacaatcttttggggcgccgtattggggctcgttgtaacgtatttaggtggggcgatggtcgaggctttgaccgccacccccatcgttcgtgaaccactcaaagccatggcggtgggtatcatattggcagtgatgagtgggttattagtgacaacgcaccattaagaactgtatgctggctttaagggcgcttagccgaccgttaacaagcttgataaattaaaaatgattcgccttcttgtcagaggaaggtgaatcattttttagtgtagatgaatcacggggttcaatggtgaactaactgtccggagtgcgttgcgcaaatgctcacgatttggatagtcggagtagtttgagtaacgtaccggcaagttcttcacgttgatgggctggcagatcactcaggtagtcgagtaatgcaacaacattaggtgattggagaagctcgtcgcgaaagaagtccgctatttttaaattcagagtttcagagattgcggtcaaactttgtagtttaatgttatcgaccttaccacgttcgagtcgagaaattagcgagattgaaacattcgattgttcggccaattgctcgatggtgatgccgtgttgctgtcggcgttgccgaatgattttgcctatctcggttaacatgggaatcctccttaatccattaagcgtcttagcactaattttagaggtttcgctatgcttgaaacagagctgtaagtaccttataagtactgttataaggtcattaaagcttttgatatgtgatgctgattaaatcacgttactttgccttcagttatcgaactcatgctgaatttgtgatccgttgaatgtgacaaagcaattattaggttacggttaatgataaaatagcaacatactataaaggtctttaaatacttcttttagtcgtatataatgttattaaagctttgttataacgctattaaataattagtatagcttgcaaagcagaatagaaatcagagtgttgggaggagcttatttcatcggatgtcaaattaatggaggagtgtaccaaaaatgaaaatatgtccaaattgtcagcatgaaaatgaggctgataatgttttttgcgaaaattgcggagcggatctgactcatattgacagtgctgaacgaacgcaagccagtggaacggagcagaaactcggggattcaaggcaatatcaagctcataaaccagctaagacgcagcaatcaaggtggttgcgaatcagtggaagcgtgcttgcagtcgtcattattgtgggaggtggatttgggttttatcaatatcacactggtaaaaatcagcagattgccgcggaagtcgaaatgatgactagtaataagcccacgacattgtcgaaacacttagttagcgataatactgggttaaaaatcacaaaacagtccgtaaagcccttaatgacctatatccaaaaacatccccagtacgcacaagatctgaaaacagacttacagcataacggttattctagtgatcacacgtttgttgttaagcaaatcggaactaagtggacactattcccaacttacaaattacgcgtcaccacgatgcagccgttaatcacgaccaatctaaaaaatgccacactggaagcaaatgacatcgaattggtgaccaccgaaagtgcgcatgccacttataaggttggtccgctgtttccggggacctatatgtttaaactaagcaattctgacacgacaatcacgcacaaggttaatctgatggggcacgcgaacgtccatgaattaatttcgttagttgcgaataaaaaggcagcgacaacgtcaacggcgaatactgacaccaaagctaccactgccagtgatgaatcagactcgagtttaatcaacagcgagagtgaatcgcagagtggtacgggcagtgcttatgatgatttgtctagttcagctcagacagctgtgtcagaaattgccgcggctaccggtggggatattagtgattatgattatacggcgagtgaaccacacacggatgtgtatgaaattaaatgctatgttagtggtactaatgatttagcagatacttatcgatatgatgatgttaatgatattctagcgcgctacaacacgagtaccggtaagtttgaaacggtagattcaaatgattaacgagagatttatgattaatttggaggatgtttaaatgaataagcaggcacttttttgctcgcagtgtggcaatcaactgaaagccggggcgaagttttgcccgaaatgtggtgctgtggttgccccaaaccaggaaattccggatcaagggcagtcagttgccgaatccgagaatacggttgaacgtagtagtgatgataccgtcaataaaattttgaccacagataccgtccaacatgtcaaaaagttctctggaagctacttttcgtggtttaagatgacgatccggcatcccggtcatccgattgaaccgactaatcggtactttggactaacttcgatcggtcttgaggcctttttactggttttatcaattgcgttaatcttacgtaaggcacaaaatgtcgccaatgattttactagttcattgactggtggtagttcggaagctgcgattcatgctggcagctttatcctaaaaacgagtatgctggtgtttttcatggttcttgggatatatgcgatttatgttagcattgcctatgcctttcgccgcgttgttaatactggttcgatgcaatttagtgattttatcaatcaatttgcagcaattacgaatttgattctaatctttaatctactcacgttgcttttgacgattctcactggaactggtaatttttctggcatgactggattgttcttctttatgatcccaaccatcgggattatgaatctggcatttatttatatcattattgataatgttgtgaagccccatattgacaaattttatgcgttaatcattgctgaaatcgcgttaggttttgcactatctgtttatgtcatgatattagccgttttaggtggcaatatgcttttctcacaactatcgtcactattttcgtaagcgttagtaccgtcggattagttaatttttaaagagacgatgccatggattcagagcggaaaaaaaggggaccagattttgaaaaaaagtgaaactgtctgtatcagcctgctgttactgttatttattagcggttgtggtagctcacagcaggcctcgcaagcgtcacatgcggataagaagcatggcgttagtgtggtcaaagtgaagcccaaagtgattactgataaggcgcacaaaacaaatgatgcaactaaggcaacgagtacgtcagtcaacgcaagttctcagtcgacaaaaataacgtctcaacaacgaggggctacgactatgaatcttaatgagatcagtcagggctcctatgggagtttgttaggtgactggaaggaagttgctagtagtgtcaataagcatgatactaagggcgatgtttggcaatctcccgaggctggcgctaaattaaccgtaaaagacacgaaaatcagtgacggtgaaatggccttagcaagcgggaaatttaaagatgcgaatggtgatgaagaggctgttactactaccatcaaacaggaaaaaggcgcactgcatatcgatggtgatatcggtgcagctgctgtcacgtactggttttatccaaggggagttgcactcagtggctggggggataacgttcctgccaccattaagacggatactgagcgaatcataacgcgcacaagtaataattcttatgtaaaagtttttgaacgtcaaacgaccgccgccaatacgggacaaatcaagtcgacgatggcgctcggccagattaaaactggtgattattcaagtttgaatgggacttggcaaaatggacaaggaaatcaaatcaagattcataatcagcggatgaaatttagtgactttggcctgacgcaagacgctactccggggacaattactaaactcaaaatggatgtcccatcattagatgatcagcaaggaaatcttaagacggttgatgggttgaagtatcgccaacaattagcttatcaaaccgcaaacggtgccaccatgcttcaaggcagtttttcaatatcaggctcatctggtggactttatgatgtgatatttatgcccggtggaaataatgctgacctaaataatggtgacctaaataatggtgatagtagtcgggaccgtatcgcggcgttaggaacgcaaaatgatccccaaaacattccaagtgataagatttattatcgctcaaattaacagtttagaggcgtaattaagttctttgtggctaagataaatatgcaggtgtcaaaaaaaggaagctcactgagcttcctttttgggcccttcaagatagatactttcataacagtttgatggcaagcgtcggtagccatctgaatgaagttgaacttgcttagtcagtagcgctcaattaaatgcggactattaaataaacttggcaatggggccggtaccgtcacccgtgtggtgctaaatggaagttgtagatccaacaattgggcatgtaacatcagccgaggcgccgactccgcttgcgagtcgtaaagtggatcaccgataatcgggtggtcactggcggccaagtggacccgtagctgatgggtacggccagtatgcagggtcagtttaactaaactctgatgggcggttgttgcacatacttcgtagtcggtgagtgctggctgggcatcggccgtgttgacccagcgtttgcgtttgtcggtagtatcgtgaccgattggcgcgttgaaatacccagttggcgtggcaaagtgaccacgtacccaggcataataagttcggcgaatttgcttgtcactgattaagcggtccagaatcgggacgacgaccgggttcaatgcgactagcatcgcaccagaagtcatctgatcgagccggtgaaccatgtatggtacccgctgagttggttggagtgtggctgctaggtcatttaaaattgatccggtttcacctggttgattaggatgcgatttcacgccagcgggtttatcaacgactaacagatcgctgttttgatataaaatcgtggctggggccgtggcagccgcaatatagtttgaggtcggagtccgaaagtcactggggataaacgtcagcgtcaggcaatcaccagtattgacgagttgtgcaattgacgttggtgcaccgttcagctgaatccgccgcgtttggcgtaactggccctgaatccgcttaggaatcagccaggtccgaaggcaagcccgaatcgactgttgattcaagctagacgggatagtgagttgataagtccaggtcatgaataaagctcctttataacggggaagacggggcaacgcacggaaaccactaaaaaagtctggaacgtatccagacttttttgttagtcttcttttttagcggtcggcttaacgatcaaaacgtcacaaattgcgttgcgactgacgtaggtggttacggaaccgaccatcaaacgttcaacggcagataagccggttgaaccaatcataattaattcattatggtggtcagcgggaaattcacgcgcgataaccgttttgggattaccaaaacgaacatggacatcaacgtcggtcaccccagcgtcaattgtttgttgcttgagttcttccaagcacttttgaacgtcttccgacaacttgtagatgacatcaccactgaccgcaccgccgtacgtgtcactaaattggttgacttccaacacgtttaaaatgtcgagatgggtcttgttacgcttagcgacttcgatgccccgccgaagaacttcgtcggtagccttggagccatcaactggtaccaggatattttgatattgttgtaacataatggttacccccgtttgatatggctagttaataactatattttagcattaattttcagcaatgtaagcatttaaaatcgattgatttatttgataacttgagtttgtaaggataattattttaatggactgaaaaatgactaatttttttcagtcggtactagtcattgaaaaataatattcttcaaggtcgttaatcgatcaatcagtcacatttaatttaaatacagtaattgagaagcaaggtgattttggaaaagcccctggtcataacgtttggtagcaatcgtcaatctagtcaacgataacaaattgttaactgatcaatcagttaaaatgataacggtgtcaatcaattgatattaataaaataattcgaagcgatctcgtttgaatgtccctcttcgacatgctaatattattctgtaatagcaggtgctacaggggaattaaatcggttgtgctaacagctaactcacggaaagtttggggattttaaaattgaaaattggaatgacaaaaaaagtagtaacttcattattgctaagtaccgctttgctgccgatgttgagtagtaaagctgatacggcaagtgaaaatcaaaaaccggcagctgcgactaagggaaacagcgctgcttcagctgcaagccaacaagtgactttaagtgctggcagtcagacggaaacgacagcggctggtgcgactgaccaatcagttgccagtgacggtgccaagactgacgatcaagctgaatcaaccagtacgacgacgtctactaccagtgcggcaagtcgtgtcacagtgcgggcagccagccaagccgctaaagctgacagtacaggactgcaaagccagtcctccgccagtgaagctgccaaggataacgcggctgctagtgctacggcggactccacaactagtgctgttgatcaacttgataaaacggccaaagctagtgcagccacgagccaagccagtcacagtacgactaatgagacggctaaagccagcgcggccgcaagtcaggatagtcatgtcactacggaccaatccagcgcgactgtgacgagtgaagtagccaaatcagccgcatcgtcagccgcacctaagcaagcgactgagcaggcggtagccgcgaaaatctcaccaaagattgagacggctgtggcggctgatgcggtccagtcatcagcgatgatggcacggtccacgcgggcaatgactagtcaggaaatcttcctgagtcagattaaagcgggggcaatctctggttggaacaagtatcaagtcttgccatcagtcacggccgcacaggcgattctggaaagtggctggggacagtcacaactagcaactgagggaaataacttattcggtatcaagggaagttatcaagggcaatcaatctacttcccaacccaggaatggaatggctcacaatacattacgattcaagacgcttttcggaagtacccgaattggtcagctagtgttgaagatcatggcgcctttttggttgtcaatccgcgttacagcaatttaattggggttaccgattatcggcgcgttgccagtctcttgcaacaagacggttacgcaaccgcgccaacgtacgcgagttcgctgatcagcatcattgaatataacaagctacacgagtgggatcaagaagcgctcagtggtcaggcaagtggcggaaatgataataaccaagttcagcctgatcaagacgtcaccccaaccagtggtacacataagtttactaagacaacgacaattcacaatgcgccggacgccacgagtgccgtagtgggtacttacaacgctggtgaaacagtcaattacaatggtaagttaacggtcggtaatgcaacttggttacgctatcagtcctattctggcgtatcacggtatgtgatgattagtcaaacaacaactaatgataataataaccaggcgacagttacgccagctagtgggtcgtataagtttaccgcaaagaccaacattcgatcagccgcaagcaaaacggctcaagtggtcggcacttataatgctggtgagacggtttactataatggcaagattaccacgggtgggacaacttggttacggtatttatcctattcaggcgctcagcattacgtggctatgagtggtgatgaggttggtgctgtggctaaaccggacgtggttgcaaccagtgggtcgtatcgtttcacgaaaacgacagcaatcaagagttcacctgcaactagtgcgacaacggttgggtcttataatgctggcgatacggtctattacaatggtaaggtgacgacaaatggtcagacttggttacgttacatgtcttactcaggtgcccagcattatgtgcaaattagtggtgagagtacgtcgaccaatgttgataaaccgcaagtaacgcctcaaagtggtagttatcgctttacgcaaacaacggcgattaagaatacaccggccggaaatgccccaagtgtcggtacctatagtgctggtgatacagtctactacaacgctaaggtaacggctaacggccagacttggttacggtatttgtcttattcgggcgcccaacattacgtagcgattagtggtaatgccgctaccggaaatacgacgtctaagccggtaacaaacagtcaaggggcgttccgcttcgtaacgacgactaatattcgtacggcgccaagtacgcgcgcaagcgttgtcggtgaatataacccaggtgaaacggtttattacaatgggacggttcaagctgagggttacacgtggctccgatatctgagtcgctccggtgcaacgcactatgttgctaagcttgaaggctaggcatattagttgttccggcgtccaaatggctttatactaaggatattgaaatgaaatagcgattacgaccgctattaatgtttcggcaacctagttggcttcggctggctaggttgttttttgatcagtttgcaatcgcttacattatatgctatattgggtttatcggaagagtcacaggtcagtatcaaccgttacccaattgttgtaacaaacccgtcaagtgatagctagtgcagtatagcagcgtttccgctaatttcggataactgactggcccaacctccatctattgatggcacggttatgtccacggagaacggattgccgccaatcaaacgttcacggatgtggatagtgaatcagtcatcttgtggtgtgaagaatgccacgccaaactttttgtatgattcttccaaaaaatgggctcacattgtgggtccttttttcatcttgctgtatgattaaagtaacctaaagctgaaggagattttaaaacatgtattatgtcgcaatgaaagatcatgagattggccgcaacttggcaaccgaacaatatttaatgaataacgtggattttgatgaaccattagttttgttctactatgaagaaccgtgcatcattgttggtcggaaccagaacacgcttgaagaaattaatgccgattatgtccgtgaacaccacatcaccgtcactcggcgtctctctggcggtggggccgtatatcaagatcttggcaacctctgcttcagcttcgtggtggatagtgacagtcaggagtttggcgattttaagacgtttaccaagccaattattgacgcactccacgatatgggggcgacgacagcgacggtcagtggtcgtaatgacctgctcgtcgatggtaagaagttctctggtaacgccatgtattcacggaatggtaagacattctcccatggcactttgatgttgaatgttgatttaaacgttgtcccacaggcgctaacagtcccgaccgacaagattgcatccaaaggtattaagtccgttcggagtcgggtcacgaacttacggccttatttagcgccagaatatcagaatatcacggtgccagaatttcaggatgccctgttaaaagagttgttccatgttgattcgttggatcagattgcggataaggaatatcacgtgacacctgaacaacaaaaagctattgataaaatttacgaagactattatgctaattgggattgggtttacggtaaatcaccggaattctcggtcaagcggcgtcaacactttgatatgggaaccattgatgcgcgcatctcggtcgatgacggcttgatcaataatattaaattttatggtgatttctttggtagtggcaacgttcaagatattgaagccgcccttaaaggggtgcggtatgaccatgaggccatcgctaaagcgctggcagatattgatttaaatcagtacttcacgggaattgaacggtcggccattattgacttaattgcccagtaataggagtgatttgttgaaactgactcgcctagttgcatttgcgtttgtgtcctttttttgttacggtatcgtcaattggatgatgtcgaccagccattttcacctgcaagcaaaacacatttcggtagcggaaatgtggcagggcctattgattgccctagtcttatattttctaggcattctggcggtgtatattaatcgtatgctgggtttttacgtcctagggctagttgtgttgatttatagcttaggacttgttagcgccttgatgtcgggctacgagagtacggctggcatggaaattaagctagcgttagaagttatgggtgtgatcgggttaggaatcaacttttatacgttggtgttactgactcgctggcgacgtgcaaattaacgaaattgaataatgaatgagggatagtgttttatgcaacgaaacgtacaagcttttattgatgatgttacggctgacaaggttacgcaggatagcttgactggtacctataccaaattagcgactaaggttaagccttggctagcgaaattggtagtggcactcaatgccgaccagcttgcccaagtgacactgacggctaagcatgagccagctatcagctttcggttggagacgagtgtcattaacctgccactggctaatttgaccgaaattggaaaggttacggcggcagaggatacgctgccaatcaacgtttacatgattgcagaatccgatgcgttaccgtcaggattgcgaattgatgagctgggaagcgttgccgacgtgctggctgatcaaaccaatgctgaaaagttactaaccgattggctgacagcccagactgatcgcttagaccagattacggcagcggaagcttaaacgtaatctttacgagttaattactgtatctttacatgactatggtaaggtaagaattgatattggagccaagccaaaatcaaaataccaatggaattgagtgtgccgttcattaaatcgaacgggatactcaatttttttgattgcgaaaagttaagtgctacggccgatttggggagcggctgctgcaagttttgtagcagcgtgacttgcaatttaacaatgaagatgataaggtagtccatgcgatgagtcgatagagtcagatcgttagtaataacggttccgcgcgagcggctagtgactaatattgatagcggggcacgtttctctgacgtatttcagagtgcttgggtcactgacattgtggagtgtcactcccgctggttttaccagtgccgcgatgaacgcgtgttaaccattttcggatggctgacacgcgttttttttgcgtgccggcacaaacaataggtttccatgagaaggcccttcagacgtgttggtcgacgaaatcgtcgtaaaataaaacggccggtcatcaggataagattatcctgatgaccggccgtcaatggactgaaagattagtcctcttcgttcattgcagctgctgactcggtgttagcagttgcccgttgcatttttccaagcacaccgcgggcgattgggccgacgatgatgagttggagtggtaatgcaacaatcaagttaaagatccaagtgtgaccgtaagtcgctaatacgtgactcccggacaattcaccttccactgcgatcccgaagagggacatgcaagttaccatgccaaggaccatcaagacggagatggtaatcccgatcaagacgacccgtttgcgcatgtaatcattaatgatatatttgaaagctaatcgtttggcaattggtcccacgaccaataagtctaaaatgatggcaacgaataaaccgagtgggtagccactgaggattgccattactaacccgctactgaaaccttgagcaagggtaacgttataggcggtcatcacaaagaccattagaccggccataatggcggtaaagacaacttcttcttttaaattacgtggcattctattcacacactcctagtttttttgtatcggttgattactatagcatgtgaagggggcctcacataagtaacaatttgatgacaaattatgaaacggttacattgttagcctattttgggccgtagtcggggtgtgattgacgatatcctgatagagcggcagtaggatggcgaagtgagattgaaagaaataaggttgcagaaatagtttcccggttagcaaaattcacttctgttatgttgacgaggcgtagtcaagaaaagaatgtcacaatgaatcttaggtgccaaaaaaaggaccaactgagccaaatataatttaaagttaaatttcaatccagaacaggtaaacgttggtaaagtgagacaacatagcgtatgctgtagttagtatcagacaattaatctttggggagttgattatcttgaaaaaaatgttagttagttcagccgtgattgctgggatcattgcgctgggaggcggttattacttagaagccgaccatcaatctagccagtcgcgggttagtgaaacacaatcagttgtgtcaaagactaaggctaaaaaagacgcgtcgtcttcagcaaagtcgacgaagcaatcaacagctaccaaatcgtcgtcaattaaagcatcgtcagtttcgacgacttcagctaatgagtcacaatccgaagctagcgcaacgactagtcaggatagtaagacaactactgcagctagctcacagggacgttcaaataccactgcaacaagtcaagcaactaccgggcagtctgcgcccgcgacttcatcaactagcggccagcagacgaccaatccacagcagttgacggctagtcagatcaatgattgggcttggcaacaagtggctaaggactatcaacaaacaacggccaataaacagaattttgcgtttaatcagtatcagagcggtggcttagtttacgtggaagtttatgaaaataccaacgccgatgtcgcgcacttagcggggcgttttcggattaattcccaaggtcaattggaacaacaacagttggctaagggaaacgtatggcaagtcgttgcgacacagccataatggcgtcgtttaactaagtattattgaaaatatcgattaccaagtgggtgttcagcgggtgccaatattgaacacccacttttttgtgccatgaccagggtgccggtatgccggacctgcaataacgggtgagcgtagcagtgcttacgattctagcgagtggcaatccactactcagtaaatattaaagctggaacattgtaaccgccttcttgctcattgtgaccaaatacggcatacttaaagtagttcataaggattggtggctggtttgatggcaaaagagaaacatgaaatttatgacgaaaaggataagcgactgggccgcttgattctgaaagtactggggatcgtcgcgattgtcagcggcttagtgggaccgttcatttacttgttgaatgcggactggggccgtgagctaggaaccttggccgtgatttgtggcggtgttgcgatttgtctgggccctaaaggtcgaacggcgggaggacagtggttggcactcctgaagacgctgggactaagtattctgattttgggatactttgtgcttgtattgaaattattaggctaggcaatatatgatgagttgctgtaaaaatggtggtcaggatcatgctggcaccatttttttatcgtactgaaataagattcgggcttgcactcctattattatgagagtaagatgaaaatatcattaaataacatgttgatgagaagagtagtcaggtcatacctttgacagggagccgcggggagtgcaaagcggcaaggtggcgcctgatgaagatgaactcggaatgcccagttgcggtcgcaaggctgtgctggcgggactggccgatactccagtgagtcaataatgacttgatgagtttaacggggtgacccgtaattgaacttgggtggtaacacgcgaccggcgtcccttgaagatggcggctttttttgtggccatttctgaaggatacttttgccaactactcggtataactagattggatgggattgagattatgacaaagcaaactgataaattacacattgaaacacggttggcgcaagctggtaatcggagcgatgatgagaagactggcgcaatttcggcgcctatctatttgtcgacagcgtatcgacatgctggtttgggacaatctaccggatttgactatccgcgtgaggcccaaccgacccgctgtattttggaacaagtgttggcagagatggaacacggcatcgctgcgtatgcgttgacttctggcatggcggcgattcagctcgttttcacgttgttcaatagtggtgacaagattattgtgtctgatgacttatatggtggatcgtaccgcttctttgacctcttacacgaccattatcatttggattttgctgtctgggatgggcaggatcaagcggccttggcagcactggcagacgatcaaaccgtggccctgtggttggaaacgccatcgaatccaaccatgaaggtcatagatattacggccacagcggctaccgcacacgcccatggcctcaagttaatcgttgataatactttctatacgccgttgattcaaaagccgctggatctaggcgcagacatcgtcgttcattccgcaaccaagtatttagccggtcataatgacgttttagccggtgcggtggtggtcaagtcgcaggcggatgctgatgcgcttgaatttaatctggtgacgactggtgcggtccttgacccgttcgacgcttggctactcttacggagcttgaagactttgccattacgtttgcatcagcaggaggctaatgcgcaggaactcgtgacggtccttgaggcagatgaacacgttgaacgcgtcttatatccaggacgtggtggaatgattagtttttatcttgctacgggtaccgacgtcgatacctttttacgagcattgaacgtaatctcgtttgcggaaagtcttggcggtgtcgagagcctgttaacagttccggcagttcagacgcacgcagatttaacagaagaacaacgacaggcaaaggggatcaccgctaacttgttgcggctatccgttgggatcgaaaatagtgccgatttagcagcggatctcaagcaagcgctgatccgagcgacaaaataaagcaaaaggctttacttacttttagtatgtggtaaactatagttattataaagatattggaggcatttttcatggcaactgcaactttaagcgacgaagaaattcgcgaacgtatcaagacgggtaaacacatgttattctttacggcggactggtgcccggattgcgctttcattaaaccagtaatgccccaaatcgaagcgaagtacgaccaatatgactggatcacggttgatcgtgacgccaacattgaaattgcccaagacatgggtgtgatggggattcctagtttcgttgggattgaagatggtcaagaaatcggtcgttatgtcgacaaattccgtaagacccaaaagcaagttgaagatttcttagatacacttgaaaagtagttttgaatggcacgtcgttagctgataactaaccgtgttaaaacgagccaacccgagtgcgtccatgatggttaagctttaaccacgatgggcgcgtttgggttggttttcgtttgggcttctgctacactattaactattaattttggaaacggtgataaacatgacaacaaatttatttgaagatgtggtggtgcggacgaccaagcttggtgacttgcccgtactacatgtgtttgcagcgagtcaagcacaaactaaattaccaacgatcatcgactaccatggctggacaaaccaaacagcgaccgaactgagcgcggcctatcagttggtacgtgcaggttttcgggtcatccttccgacagcatatttacatggcagtcgaaatgatgggactgatctcgatcggcatcccgaacatttttggtcgattgttggccattcagttgcggaatttccacaattagtcgcggccctagtagctgctggaattagtgatcctaataaaatcggtgtcatgggaacttcgatgggcggtattaccgcggccggcatcatggcaacacagcccacggtcgttgctggtgtctcgttgattggttcaccggaaccagtggcctttgcaaccgatcaagtggcccaattaccagcggcattacaagctaagctccccgcagaactaattgaacaaacttatcaacaactggcgaagtttgacttatctgaacacccagaagcgctggcaggacgaccaatgttctttttcaatgggacggccgatcaaatggtaccttatcagtatattcgtgattttaagcaccgttttaaagatgagccagccctgaaggcaactgtctttaagcgcgctgagggtggcgttcaccacgtccctcacaagattcaagaagctgctgtcgccttcttggagaccaacattcttaaataatgcacacagcacccatattgttcataaaactgaacagcatgggtgctttttattgccatcaataccataaccgtcgaacactatgatagcctaaatcgcctaaaagtagtggctctgacagtaacattagacagccgcgttccagtaagaaaatcgcgagattcatctcatcatcccaccgggcagcccgctcattgagccgacagtcgtaccttgagctcgcctttagagcaagtgaattcattttgaggggggtgtggcgcaagcggggaacccgggtgaggagccaggggtaggccagcaggtaggaactgatcagccaataaacagggagattaaaggtcagctgccactgtccggtcggtttcgcggtaagcgcatagtacgtcattattaaaacggggagggctgacagttcggcagtcagaatattaattgctttatctttcatcattatttcaccttgccgattggttagatcaagccgatgtataagcggtcaatgttttccagaacaacggcaggctaacacgatttcgggccaatgtcaggtcatcgaatttggttagttaagccaatatttacaaaataatgattgtttacaattgaattttgaacaatttggatgtatcctaataatcgtaaatgaaaacgtatacaacaatattaaaaaagaaggcatttactatggcaaagatgattgaagcgtccgttgcaatgttaaaggttattgaagcttgggatgttaaacagatttacggctatgctggtggatcgtttaactcaaccatgcacgcgttggatgtcgaacaggaacgactccaatatgtgcaagtccgtcacgaacaagtgggggccctcgccgcagctgcggatgctaagttgactggtaagatcggggtcgcctttggttcagccggccctggtgccgttaacttactcaacgggttatatgatgctaaggaagatcacgtgcccgtacttgccttggtgggccaagttgctcacaccaatatgaactatgattatttccaagaatttgctgaagaaccaattttcagtgacgttgccgtctttaatcggaccgttatgaccccagaaagtctaccatacgttgttgataaagcgattcggacggcttaccgtgaaaacggggttgcggtggtgacgattccaaatgatttcggctacgttgaaattcctgatcttaattacgattcagccagtgtccctgctaaactaaccggcattcctactatcgatgatgaacaagttaagacggtgttaacgatgatcaagaacgccaagtaccccgtcttccacgttggtcaggggacgcgtggtgcaaccgaggacatgatggcgttagcagaacggttgcaagtaccgattattatcacagggctagccaagggtgttattcctgatagcttcgatggcaacatgggaagtgcttatcgggccgcttcgaaagcggcggatgaactgatgggcattaccgatttggtcgtctcagtcggcgcggattattcgttcgcacagattatgtatacgacccacgacttcaaatatgtgcaaattgaactggatcctggtaagtttggtcggcaccatcatttggactttggcgtcaacggcgatgctaaggtcttcatcaaacgggccttggcattaagtgaaccggcgtcaccgtcaccatattaccaagctgctaaagcagacatggccgactggaaacagtatttgaagaaactgagtgaacgaacaactgatccacttgaatacgaacaagtctaccaagaaatcaaccgggtcgctgccgatgatgcggtcttctcaatggatgttggtgacaacacgattaacagtttccgtttcctaaagatgaatcccaagcaaaaattattgacctcagcactatttgccacgatgggtgccggcgttcccggtgcgattgcggcgaagatgagttatcctgaccgtcaagccttcaacattgctggtgatggcgccttctcaatggtcatgcaagacttattgaccgaagttaagtatcacttgccaatctttaatattgtcacgtctaaccaaacgttgaactttattaaatcagaacaagaagatgtgccgcaaccatactatggtatcgacttgattgatgctgattttgctaagatagctgaaggaatgggcgtcaaaggtatccgtgttgaacattttgatcaactgcacgcagccttcgaaactgcgatgaccgaattaaaggccggccgtccggtcttaattgatgccaagattactgacaaacgggggttaccagttgaaatccttgatgttgatccagccaagacctcggatgcttctgtcagtgccttcaaagaaaaatatgacgcaaacgaattgaaaccactaaccagttatttcaaggagttcaacgtcgaatagtcagtatgaacgagcctgcaatcaatcgattgcaggcttttttgtcatgaatcattgttaaaaggttccagttggttcgattcctgttcgtcagccagtacgcgtcctattccgacctccggggctgggtgacaattgctggaacgtaagccgacgtcgatttgagctaacgcacaacccgcgtcatctcaaatacgagtcttattctaagccggaagaaaatcacttccagctaagaataatttggctactgagcattgtcacccagcccctccagtcgggaacccgctcgaatggctgatgaacgaccgccgaactcggtacaatttgtcgttcgctattttgatactggaactttaaacaaagcgttaggtgtattaagcactctgtcaagagcttaaatcttactacaccaattcaggattggtgagctatctcaatataattttcagtctgacagttgattgacaaaattatggtttatgaaaaacaatgacgaattcgcgaaaagttgggtacgcacatgtctgccattcgaatactgtcccgactggaaggcgtttctgacaatgcccagtggtgaaatttcacttagcaagcgttctttgcttggttagtgaaaggccagtatttaagacgtgggcttcggcttaaatctgtgcccaccacgttccggcaattggcagaaatgcctggaggtcggtgtaggacgaaccaactaaaaaagtttacgctaactcgcacctgtttccagcgggcctaagctggctgcttttgattttagccaactggaaccttttaacaatatttcgtgcagaaaaggcttggtattatgcggatataattttagggcgtcattctgcttggtctgggagttttaaaagcggataatgaagctaattctagggggagtgatgaggatgaagcgacggttgattgcagcgccgacgggtcttttattggtgggatggttgattggctggggcttgcaagcaatgcaccaaccgatggggacggcttggacggcctacgcgtttacgttattgattttatatacaattttggcgacgtttatcactagtatggcggatgcctatcagggaaggcatggtcgaacagtaccggaaaaacaattttactggtatatgtgtacgttatcagtcattttgacaattttagcgatttattggatggcacataattagggggattaatgctaatgcaagatgaaagtgattggttaatgcggcagttacatgcgttcgcaacggggctagggtacacgcttagtcgtcataagggaggcacaactgaggtggtgtttccgcaagatcaagctcagccgttgccacatcaaatcgaattggcacaactgattgacaaaaaggcttatgctcaagccgctcagcggttgttagcgttgcagttcgcaatgacggaagctgaattcttaaaacttgggatttggttttacgcgacgcttaatcaatttgacgaccaaagtctcgctgccggggggatttcacgagcatcattggtggcgggattagaacaactgcaacgattgaaaatgtgatgcgaagatttaggcaaattacgaatgaatttggcaaaaaggggtttcagctatgacgaaaaggttaaaagtcgtgctcgcagaatttaattctgaaagcacgacttttaatttaacgcgtgttcaattatcggaccacatagacttggtcgtgaatcaggtcgaatggtcggaaatgagcatttaacttggtaacggcctcgttctcttgataattagcgtggtcccaaaattgtttggaacccgtggcgccgtatttttcgccaatgacaatcaatgggatatcgtaaggactttgccgcatagcttgtaacaagtcccaatcaatagtcaatttgtccggtgaccaggccataatgacgtatttaatagttgcggcgtacttattgaaggcactgacggcatccaacgcttcaatcgtcgtgactgggtggcgtcccgtctgattgccagtttcgtgtgtccaatcctttgaatccgtggtataaattggctgaccaggatggagacgtttgaggcccttggaaatatagccgttaccggccatgacttccagaactggcgcgctgccggtgaagtcagctaggtctttcaggaatggtgcactgatgtaggcccacatcccgtactgatcttcgatatagtctcgaaagttgcgtagaagttggtcaacttttgggagcgcggctgatagttggttccaagctgcatcaccagcaggatcacccatggcatattgctgattgatgcgctcaaagagatggtcctgaaaatcatcagggacttctaagactggcaattgttggggagctaagccggctgccagcaagcgatcactttccaagacattattgatcagtactagaatttggggatcatccttaaataagtcgcggtacttcattaactgttgaatatacggggcaccggcttgctttttgacccgcttttttaattgttttaacttcttgggattcataaaaaactcctagtcatcaaagtgtaagtctaattcttcttggccggtcgcatccgttgaaactcgatgctggcgaccatgtaagtaaccatccatcaactgaaacagttcatagcggtcttcactggataattgttcttgattaaacgtcaacggcttgcccgataaaaagatgcgaccgaggtcatactcttcttggtctgatttacctgacaagtaatcggtcgtgacgttgaaaaattcggctaatttacgaacttctaggtaggacggggtccgtaagtcccgctcccagttaccgatttgagccgcggtattttgacgagtcgtcttgtctgcggtcggcatttgattgagggccgccgcgagttgagcgagggtcattttttgcccccgacgtagtgctcttaaacgttctggaaacatgtgctcacttccattccttagattaacggtgcggataacgccatgaattcatcgatatcccgcttgatcaaagccacaccagcttgccagaaggccggcttggtcaaatcaacaccgaggtgcttggcagctagggcttcggtcgacatgttggcggtgtctcgcaatagggcaatgtagcggtcttcaaagtccgattgtgttttagcttgagcatagataccgagactgaaaagatagccaaatgtgtatgggaagttataaaacgggacgtcgtcaatgtaaaagtgcaacttgctagcccaaaacatcgggtggtaagtatttaaggcattaccataggcttctttttgggcggttagcatcaagtctgacaaagtgtcaggggtgacgatcccgtgctgacgggcggtatagaagcgcgtctcaaacaggaagcgagctcgaatatccagaaacatggctaacggattttgcattttagcatccaataaagttaatttggttttggcatcatcggccgctttgacactggcgtcagcgacaatcagttcggcgaatgttgaggcggtttcggccacgttcatcgcgtaatcctgacgccaaagtggtagatcttgaatgacgctgccatgaaaggcgtgccctaactcgtgagcgagggtggcggtgtcgttaggtgaacccgtaaacgtcatgaaaattcgggattcgtgggtctctggtagattttccatatagccaccaggccgcttattagggcgattctcagcttcaacccaacgatgttcaagggcgtgttgggctaaagcgcccatctttggactaaattggcgaaagttgttaatgacaaaatcggcagcttggtcgtaagtttggctaggaagttgtcccaaggttagtggggcttcaatatcttgccaatctagttgatctttaccgagtaactgggccttacgcttcaggtaacttagtaaaatgtccttgctgtcagcgacaacttggtacattgtgtctagtgtcgcttgactcatgcggttgagttctagtggtttctgcaggaagttcgtcgtaccatgcgcacgataattggcaagtcggaagcccgccaagtggttcaacgtatcagcaaagggagcggcgtgagtttgccaagcgtgctcccagttgcgcattaattcggcgcgttgggcgttcggcatggcggctgctaacatgttttgagcttgacccgcggatagttgctgggttatcccgttttcatcggtatagggcacttgaatttggctaactaacgtgtcgtagtggtcactccaaccctgaaaaccgtcgagtgctaagtcattgattagggcttcagtgtcgtcatctaggagcgctaagccttgctggcgcatttcggttaagttaaaggcgatggcttgtagtgccggttgttgcacgagcgagtcaaaggtgtcttgatctaacttaacgagttgcttcttgaagcgggttaatagattgcttaactgattgtcaagttgataaatttggttcagtagtggggcggctttggtgtcgtccgcatgtgcggattgataagcaaccacgaaaacggtagcttggtcaataccggcttgaatggcttgcagactgttgacgagttgggtaaaccagtcggcgtctggtgtgtcagcggcagcacgccagtgaactaaggtgtctgctgtcgtggtcaactgctgtttaatcgtggacatttttgcagttagtgctggggaatcaatgccgccagcaaagatactgtccaaatcccacgtttcggaatagtgcataaaaagaagcctcctcaatctggtctagttatctttaattataacggttattatgaagtagtggcgaaattttcccgctcaaaacagatttttgtctcatcaaggagtgaattttaatgaaaaaatggtggatcacactgggggtactcgttgttctgttagcgggagctgtgattggtgctggtagttatttttatcacgtcgcaattgcccgtggcgataagtcatttgttacgcagagtacaaagctatcgaaaaaaagttcggtttatcaccaaaagtattggtatttacatgcacgtaagcaaacttggactattgagtcatcggatcatttacggttggttgcttggtatattccagttaaaaattctaagaagactgttgttttggcacacggatttgctgggaataagggtttgatgggtgcgtgggcggggatgtatcatgaactcggctacaacgtgctggttcctgattcccgagcaagtggtgcgagccagggaaaagcggtcggctacggctggctggagcgccgcgacgacttgcagtgggctaaaaccgtcgtacatagaacggccacaactcaaatcgtgatgagcggtatcagtatgggggcagccgggatgacgatggccagtggtgaacggcagttgccgcagatcaaagcatacgtcgtcgatagtccgtttacgagtgctgatgcgattatcagttatcaagcggggcaactctatcacctccccgcatttccgttggtcaacgtaaccagtctgattactaaattgcgtgcaggttatagtttcaaagaggcggatgccgtcgcccagattcgcaaaaaccgcttgccaatcatgattatcagcggcacccgggatgattttgtcccgacgagcatgggcaagacgctgtaccgcaacgcccaccagcccaaatccttgtggttagtgaagggagccggccacaccacggccatcaaccagaattaccaacgctacaaacagcacgtcgccgcattcttgtcacaatatgtacagtaacaccagcttgcttgaactagcgctgatttgtcatgaatcatgatattaagaggacgtttgtctgattcctgttcgtcagcaatgatcgtcctattccgacctccggggctgggtgacaattgctggaacgtaagccgacatcgatttgagctaacgcataacccgcgtcatctcaaatacgagtcttattctaagccggaagaaaatcacttccgactaagaataatttggctactgagcattgtcacccagcccctccagtctctagagtgtgaggggccacgggttgaagccgagcattgcctagccaacggattaatgcggttttggcattagtccgttggcgtagcaagcacagccttcagtggcaccgagcacgtttcggtaagccgctcgaatggctgatgaacggccgcttaacttggtgcaattggtcgttggctattttaacacgggaactttaagtacaatatcaggatgtattctctactttgtcgaaacgttcaattattatgactggtgattccgaaatagtgagctatcacaatatcactttcagtctgacagttgattgacaaattactgtttgtaaaaaaaatgacaagtccaccaaatgttgagtacgcacgtgtctgccattcgaataccatcccgactggaaggcgtttctgacaatgcccagtggtgaaatttcacttagcaagcgttttttgcttggttagtgaaaggccagtatttaagacgtgggcttcggcttaaatctgtgcccaccacgttccggcaattggcagaaatgcctggaagtcggcgtaggacgaaccaaccaaaaaagtttacgctaactcgaacctttttccagcgggcctaagctggctgcatttgacctcgaaggttagcctcttaatatcacaaaagctcccaagggtatactcctaccaaggtagacaagcaaataattaaagcttgtctattgaggaaggagtattttttatgggccgaaaaggttcaaggtacagtctggaagagaaactcttttatattggattggtaagggatggtgtatcagccacgtcaatccatagggagtacggtgttcatcactcacaagtggcacagtggatcatgcgatatgatgacggtgggccagaagcactgagtggtcgtcgatatcaacacgcgtactcagaagcgtttatgcttgaagtggtccaatcatatctagcaggcggcacttcatatccacaactagccagaaaatatggcattccaaatcattctgttatctatcagtgggttaaccggtatactagtggtaaaccactcagagccactaggaggacctccccaatgaaagacggtaggaaaaccaatcagattgaacgaatcgaaattgcacaatggaccattgccaatgaaatgaactacggcgccgcgaccactcacttcaatgtatcttatggtcaagtgtatgcctgggtcaagaaattcaagcaaggcggccccgacgcactcgcagatcgtcgcggtaaagctaaagaagataacggtaaattgactgaatcagaacgtaaagatcttgaaatcaaacgccttaaagcacggctagaacgtgtctctacggaggtcgcgatattaaaaaaactccaagagttcgaaaggatagatgcacttcagaagaaaaatatcaaaccgttcaaacgctctcacaaaaaataaatcccgacactaagcgaccgtatggcatcagctttatgtgtaactatgtcggaatctctcgtgccgcatactacaagtggactcaccgtgcagtaaccgctcatgagcttgagaatgacgtgatattaaactacattattgcgcgtgaagaagcccaaaactacatttacggcgtccgtactatgacaatgtacatcaacacggagacaccttaccatgtaagccaaggccgagttcggcgtatcatgcgtaatcacggtatctactcgtcaattcgagtggccaaacgcgaccgcaaggcagaaaagaaggaatatattctcgccaacaaattactctgtgaagatggtagtcatgactttacccctgaacggccgaatattacctgggtgaccgattgtagtgagttacgatatggcacaaagatggcgcaacgcctgcgcttaagtgccgttaaagatctttatgacggtagtattatcgcatggcaaattgcaagtactgagacgacccagcttgtggtcgatacgatgaagcaagctctaaaaacaactcatggtgtcaaacctgagattttacactctgatcagggatcggcctacacatcaggtgcatacaacacgttactagctggagaaggtatcgtgcacagtatgtctcgtcctggaactccaggagataacagtccgatggaaagcttctggagccaatttaagaccgaggagttggcattcaagcaaccactctccgaaatagagctcattaacatcatcaagaagtacatcaattggcataacacggcgagacgccaattgacactaaacggcatgaccccggaagaataccggaatcatgccgttcaagaaagtgcataagattttaattatttaattgtctacttgacacggagcagctcccaaaccaattcgatttgggagcttttgtgatattaggataattatgcccggtatgggacctggcaaggtacgtcgacgccatctttgagtgtgatcaggtataactggtcaagcacggcgggaccctgtgaatggcgagctccccaagtggttagcaattggttgaggcggctagcgacttgatggtggtcggcaacacagtctaggtcttgtgcggccttagctaaggcttgttgtaattcgggaattgcgcgtacttcggggtcactataagcaacatcgatggcgcgaattaacgcaatggcgttttcgttttttaacatgctaccatccctctcctgtgatgtggcaaactaggccacgtcctaactcaagtatagcgctcctgaattgagattcaagccacaaatgtaaccgctgtcataagtaacggtgggtcagcattgtacttttggtatgagttgtgttacattgtaatagcgaaataggacactaaggaggccgttaaattgaaatttgatgacaaggttccgatttattatcaaatcaaacagtatatttatcataaaatgattgacggaacgttaccaccaggggcaaagttgcccgcagtccggcagcttgcgttggacttgacggttaatgttaatacagttcagcgggcactcagtgagatgattacggaaggcactctgacgtcccaacgaggtaaggggaatttcgtaacggaagatcaggcgcatattatgcaattgaggactacactggtgaacgagcaattagcattagcgtacgaccaattgcacgcactaaatttaagtgacgccgaaatcgtggcgagtctgcaacaatacattgcccaacgagaggagcacaatcatgacagcattgacgattaaggatttacgttataaacataatcaacgaatgattttacaaaatgttcaattaaccctggcgcccagcaagattgtcggtttattaggtgaaaatggggcgggaaaaacgaccttgatgcgactaattacgggtagtgccaagggtcagggcagtattgtgatcaatggcgcgacaactgccgtagcccgtaagcagcaggtaagtttcacggatcatttgactggttttagtgccggtatgaaattacaacaaatcgcgcaattttatcaacttgtttatcctgattttgacgccaaacgctatcaagagctggttgactttctggaactcaaccaacaacaaaaattgggtgagttgtctaaggggacccgcgagaaattaatcattgcgctgaccctgagtcgcaaagtggctttgtacttattagatgaaccgtttagtgggatcgacagtatgagccgcaaaaaaattattaacagtattatcaagtggacgcctgccgaagcgacattattgattagtgatcattatgtcactgaaatcgcgccgattcttgatgaaatcgtggtcgttaaggaccaaacaattgttgttcatcagggtgcagatgagattcgcgacgaacatggcatggaacttgaagattattatgagagcttatatatgggaggtgtgacggatgacaagtagttggtcactatttaaggccctcagttggccacgctttaagcaaatgagtttattgattggtatcgaagctttggcggtgattgtcactagtttgtggactgccatcaaaggaaacttcacagctgccacattattctataatttatgtgcttggatggcgttacctttaatcgttgggtttatcttattggcagtttcaaatgaaaaattcttccgggcggggacgttctggttattgccaattagcgattggcgacgctatacgattaatttagtcgtttcgttggttgatattgtttatgtttggttggtccaagtgattttattctgcttaactctgtggattggttggaatgaactgatgggaggcttaacatcagcgtcgctgttctttagccagtttgatgcgggtagtgccgtgcagttcgcactcggaacgttgctagtcttagttcttgtgacgattctgatttggaacacgataacgctttgccattttgttacgaatgcgaccaagggctttttaccacgatttcggcaacggttcgtcaatgtgattatcacggtggtggtcatttacgtagctttccgcttagctaatttgttgattagcatggtcagctttctctccagtcagctagtcaaccagggacaaatcgattctttatgggtcggtagtctcgtcatgttggcagttatcttagttgaaggtgtgttaaataccttgatgttgcaaaaatgggttgagccaaccttgaattaatttagtaatcctaaaaaatcactcattcgtattgaatgagtgatttttattgcgcattttttaaacgatggttgcacctaagctgtttttgaagtgacgcaacgcccattcgtgaccagcggcgtcaaaactagcaacggcatcctgatgaatgacgagttggtaacccaaattataggcgtcaacagccgtgtgaaggacacaaatgtcggtacaaacaccgactaagtgcagggtgtcaacatggcgttctcgcagacgtaaatccaaatcagtacccgcaaatgaactgtaacgcgtcttgtcgaatgcccaaacattatcggcggcttgatgatcagcgtaccaatctttgagtggcccatagagttcacgaccccaggtaccccgaacattatgaggtggaaacaacttgctttcgggatggtaaggatcatgcggggtatggacatcggttggcagtaagacccagtcgcttgccgtagccatttggttggcgagtttgacgatcgttggtgcgagcgcttggccaggttgcccacaagtgagtgccccgccgtcagccacaaaatcattcgtataatcaataatcagtaaggcttggtgacttgccataataaaggcctccaatattaggtttgagattggttttactgtaaacaactctgatgggactgtcaattgtttaactagcgttggattgactaaataattatattaatgagatttggagctataaggacagcagcttgctgaaagtcttttctgaacaataaaatattaataatattttgtggccgaccaaggcgccaggtattgggcgttaatataaataattgcgaatggcgacttattagccggcgttctgtttgctaattgctgatttttgccccaaattggcacagtagccgccgtcctgttttcccaatcgttaaactgagattgggttattgtcagttaaatataaaaagtctagccagcgtgttgagttcgacaacatgctggttagacttttgatgggtaaacgaaagttgagtcgctggcctgatgattattctgctagttgatcagtaattgccgtgacaatttggtcaggggtcagcttaaattcatgccgcagttcattagttgtttcacggtcattaaagcgtttggcagcaccaaagttcagaacgtgcatagcgctgttgccatagtagcgactgactttttcaccaaaaccaccgctgagactggcttcctcaaccgtgacaactaactgatggtcggcctttaagttggccaaagtcgtcgtatcggggtcagaaatgtcccggggatcaatgagcgtcgcgtcaatgtgttgctcagctaattgttgttgcacggctgttgctaaaggcaggagactgcctacaccgagtaaagcaacttgctgaccagcgtgtaatgtgtgcatcttagttgcgtcaaaatcaggcgctagaggtactgactggacgtcattacttggtacccggatggcaaccggaccgttattttgatggagagcccagtgcatcatggcttgaagttcttccttggtcgttggcgctaagtaagttaagttaggaatattactgagcatggcaacgtcaaagataccttgatgagttggatcgcctgcgttaatgcggccaccggcaaccatgatcgtaacgggcaatttattgatgccaagatcatgggatagttgatcataggcccgttgcaagaaggtaccagaatggaagacgattggccgtaagccttgttgggcctgtccggcagcaaatgtaatcgattcttgttcggcaatgccgacgtcaaagtaccggtctggatattggcgagcaaagcgtttgaggtcataagttcctggaacagccgccgtaattgccgtgataggcgtcttggctgccaactcatcggttaacgtggcatgaatgacatccgtatacttttccttagtgttggggtgcaacgtctgaccggtcgtgaggtcaaacgggacgtgccagtggaaagcttctttattagtgattgcgggttgataaccgtggcccttctcggtatggacgtgtaacacgatcgggtggtcgatatccttaatttccttaaaagtcgtgagcatggtctcaaggtcgtcgccattatcaacgtagcggtaatcgaggccaaaatctttgaacaagttatgggaactcgtgccgttagtttcacgaagttcacggagattttggtaaatgccaccatggtcttctgcaatcgccataccattatcgttaaccagaataatgaggttagactttaaggtggccgcgatgtttagaccttctaaggctaaaccaccggataatgagccgtcaccaatcactgccatgacattgccggatttgccctcaaggtcacgagcaacggccatgccagttgccaaggcgatcgaggttgaagtatgaccgatattgaaataatcgtgggggctttcttctggggctgtgtagccgctgacatcgtcataatgggcgggatcaagccaagcttgcttgcggcctgtcagaattttgtgcgtgtaggattggtgtgaaacatcccatacaaccttatcaaccggtgaattaaagatggtatgaaaggcaatggttaattcgactacgcccaagttagggccaacgtgaccaccagtttgactaactttattgagtaagacgtggcgtaattcgctcgcgagttgggttaattccggcaaggataattgtttcagatcagccggctgatcaatacgtgctaaaatcggtgtttccattatctatcgctcactttctcattcgtgaatacttttatagattagcaccttagagccactctaagacaagtgttttgttttaaaaatatcataaaaaatgacgccgacaagttgtcaggcgtcattaggttaccatggtcacgagattgggggctagttgcgatgcatcgtcggcagttcgaccaatggtatagctttattgtaaccgaatttggtgtccaaatgggggtaaggacagttggtcacgttattgacattactaaaccgctttagtcggtattgatcgattgcaagtagactaactggtccgttgaaatttgttcatagagttggtttccaagttcggaactgaacgtttgattggccaattgtgtttgtataaagttatattccaactggaacgcttcgatcagaagctcattttgagtgtcttggaaatcccgttcgccagatagacggcgatgacgctcatcataggcacggcggacgatcccgatagcttgctgattgtcagcagtaatcgtgtcggctaaataggctaacacggcctcatacggtttttgttcgatttggcgcatttgttgccacatttgccgattacgagtcaagagttcagcacgactctgaccaccatggggccggtattgtcgaaacattttgcggcgggcgcgagcttttttgctgagcgaccacttgctgattgtgaaccggaagatcaatctaaagcgttcgaaaaaggtttgttggttctgcagacgtgtttgactagccacccgcatgtatttctcggcggcatggggcgtgatctcattgtcggccaccatttggtcaatcgtcgcttgctcaatttcaaacgtgtcgttgaatagacttgccagttgcgaacgcttcggccggccgtccagcactcgctggcccgaaagaatggcaacaactttgcttgtgttagcgttgttgccatgacgggcttgcatgatgtcaatcgcgtgggtcaccatgtcagctttggcggtagccaattcgtcttcagtaaccttaatggcttgtttaggtaacatcagtggcagcaagatggtcggtaccaacaaacttgtgagaatcaccaccgcggcaacgaagataatgtcattgcggtagggaaaagtactgccattgagtgttagtggtaatgagaaggccatcgccaatgtaatcgtgccgtggacgccgctcaagcccatgacaaatgcgttacgggtcttttcatgctcatcccacgcgcgaatgcgggctaagtcgaaacgcgtccagagaaaacgcgcgaacgtcatgatgaggtagagtaagatccccaggccaattaataccgccactgaccccgtatcacgttgttgtaaatgattgatgacgcttggcaacgaaacgccgagcaatacaaagacgattccgttcaaaatactcgcaacaattgaccaggtcgtcgtcatgacgatttgtaagcgcgacgtggtcaggcgtaattgattggattggacaccatggatgagcccggtggcaacaacggctagaatgccggaaacccctaatgattcagctaagaagtagacgacgaacggtgtcagcaatgtataaggaacaatcacagacggggcgtcgacccgcatgcgaatgagcataatcctgaccgcgacaatgacgtatccgataattagaccgacgataatcccaccaacaaagacgtataaaaagttggtgatgccatgccagactgaaaatttaccggtaataatcgcagcaatcgctaagttaaaggccacgattccggaagcgtcattgaacagtgattcattttcaagggtcgtcatgactgctcggggaatcgcaactttagtcgtaatcgatgagaccgcgacggcatcggtcggcgtaatgatcgcgccaagagcaaaagcgagtgccagcgaaaactcgggaatcagtaagtgagtgaccgtaccaacaattaggatggtcacgatggctaacactaccgcaagtgacagggtcgtgccaaactggtgactgagcttgcgaatattggtgttctggccatcgttaaacattaaaatcgaaataataacgaataggaaaatttcaggctccaattcaaaatttcgatacaacggaaccagagacaggattaatccagccccaatttgtaaaaaggcgactggaatttgattaaaacgtgcgtagacggcgttagcgagaacgactgccgccacgagtagtaagactaagaaaacggtttgcacaccaaatttcctcctagatttagtaaagtagtttaattttaacgcactcatgtgaataaaagaattatctgcgatgattaatttgggttggacctaatgtttaaaaatagactgattaggggttaattattgaacgttttgacctaaagtttgtcatttgcttggcgtggcattctaagtcagtataatgaaattatcaacttaactggaggacatcacgatgttaacaattgcttatatcggcaatggaaaaagcgctaaccgctaccacttgccattcgcactgaagcttaaagatcaaatcaaggtgaagactatctattcacgctcaggacgccagaattggcaaccaattgcgggcgttcattatacgaccacgttagcagacatttatgaggaccctgagattcagctcgtggttgtttcgacgcctagccatacccactatttggtagctaaggatgtcttgaatcatggtaagaatgtcttggtggagaaaccatttacggagacctcggcagaagcccaagaactttttgaactcgccaagcaaaaacagttgtttattcagtgttatcagaatcggcgctttgattcggactatttgacgacacaaaaggtcattgaaagcggggtccttggtgacttgctggaagtcgaaatgcactttgattatttccggccagaggttccaaccaatgttgaccatttttcattagatacgagttatttatatggtcatgcttgccatactttagaccaagtgattgcatacttcggggagccggatgacgtgcactatgatgttcggcaactattgggaagtgaccggatgaatgattattttgatatcgacctgtattacggtgccttgaaagtctctgtaaaatctagctatttccgcattaaatcacggccaagcttcgtggtttatggcaaaaagggcatgttcgtcaaagctgacaaggaccgtcaagaatacgatctgaaacatttttacatgccgaatcacgctgactttggcattgatcaacctgaaaactatggcacgttaacttatatcgacgatgcgggccagtaccatgaagaagccgtcgtctcggaagtcggtgactacagtcgggtttacgccggtgtttacgacagcatcatcaatggacaacctaagttagtcaaagatgaggaaacgttgttgcaagtgaaaatgttagaaactggtattcaacaatgccgccattagtgcttcttgcgtgttgcactagcccagctattagtacgtgtcagctttagattgttgttcgtcggccgattgttggaggtcggtgtaagccgacgctggctaagcatgtttacgtaaactcgagcttttttcagcgggccttagctggttgcatttggcaggtattaattcgttaatatgaattatgaggaggattatgatgcgattagggattttaggaacaggcaagattgttcaggacttcttgccaatggtgaagcgcattcccgcgattgaattggtggggttgctgtcaacgccgcggagtgtggcgcgagcccgcgagctgcaagccacgtatcgtattggaacggtctacacagattatgcagctttgctagccgatacgacaattgatacagtgtacgtcgctttgccgaattcattacattatgactatgcgaagcgggcattgcaagcggggaagaacgtcatttgtgagaagccgtttacgttagtggcatcccagttaacggaactaatcgaattggcaggtcgccaagacttagtgttaatcgaagcaattacgaatcagtatttggaaaactatcaggcaatcaaacgtgatttgaccaagttgggcgacttgaaaattatcgaatgcaactattcgcagtattcatcacgttatgatcagtttaaagccggaacgatcttaccagcttttaatcctaagcttggtgggggcgccctgatggacttgaatatttataatattcattttgtggttggcttgttaggcgcaccaacgcacgtgcagtatttagctaatgttgaacgaaatattgatacatcaggcatcttagtgttgacctatccgaatgttaaagtcgtttgtatcggtgccaaggattcgacttcaccggtacgttccacgattcaggggacgactggttcgatcattgtcaacggtcctactaatacggtcgaaagtatcactgaaattgcacatgatggaacgacaactgatttagcgcttaatcaagctgagcatcgaatgtatgctgagtttgtggcgtttgaacgtcttattgctaatcacgatatggtaaccgttaagcggcaattagatcattcccaagcggtcatggaagttgttgaccaagcgttagcgagcgcgggattgcaattgggctaatgcggcgttgctaacgtggccgcacaataaatagaagagattgtaaaaagcgtgtcctggagctgctccgtgtcaagtagacaattaaacgctcttgattcaaaatcaagagaccctacacatttgattcgtcgaaactttgttcagttttcaaagatctaattccgtgtgttaatcgcttaacacaacttaatcatcataacatcttaatcaatatcttgtcaacaactttttttaagaagtaacttgattgatttgtcgtggttgccgttgcgacaacagaaaccatcttaccaattactgaagaagttgtcaacaactaatttcaataattatttggtggtgaatcgcatctgccgtagcagcaacgtttactaatataccaatcgaatcaaaaagtgtcaacactttttctgaatttctttttatgaatagtcaaattcgctcttcttctctatactagttaactaaaaggagcgagtaattatgctagcatggctaccattcattcttatttcactactatttatcgttgtcttaatcgcttgcgcgcaatctgcacgcacaaacatccaacgcgttaagcagctcggtttaatcgcctttctttgggtgttaacagctttttgttacacgcccaccagttacaactttggtacccaactcgttattcaatatattcagtggggccccgttaaactcaacgtgattcctttccaacaaatggatatcgaattctggctcaacgttcttctcactgttccgttgggcggtttactggcgtggaattttcccgacctcccttggcgccggttcatctggttaggactactcaccggtttgaccctcgaagcaggccaatttatcctcgattggttagtcaatatcaaacgctgggtcgatatcgatgatgtcattactaactgggccggtgttattctcggggccgtgtgctataaagttgcacgtcacgttccaggattacgttggctacaaaaatagcccatatatagaagcaactcattgtagggtgccgtcaaaattagatatcgcaccccgcatccgctactgtctgcacgtgtatcagccctcgtcactgctatcaaataagcgtcgcaaccttcattggttgcgacgcttatttgtatagtacgcatttttctgattgagttgctaactaagcttcaaagaacaaatcaaaaatctgttgccggtcgcgattccaaacttggttatcgctcgttggataaacgcgattcgttaatacgaccattccaacttgtcgatccaagtcaaaggcgactgctggcccggtaaatcctgtgtggaagtactggtgacggccagcacgtcgttcccaacctaatgtccgaccatgctcatcgtattcgcccagccagtcaaatacgttctcatccaacacacgtttgccctgatactcaccgaagttcaacatcatctcaacgaatactgataaatctgtcaacgtcgagaacaatccagcatggccactctcgccattcaataagaacgctttatagtcatggacttgtccttgaatctgtcctcttcgtggatcaaattccgtgggaacaaaccgtatcttgggccgattcagattatatccggtattggtcatcgcgagcggataacagacatggtcctgaatgctccgagctaacgaaccgtcaacggcgcgaatgatccaaccaagtaagataaatcccaagtccgaataaacatacgccgtccccggcgctgttactaacggcgcatcataaactgccttgatcaaatcttcacgctgcatcttgtctagattatcaatatctgctggtaacccactattatgaagcaacaaattttgaatcgtaatttcaggatgtgtgaaccctggcaagaaccgcgcgaccgaatccgttaaatgaatcgtatgatccgatagtaactgaaaaatcctagtcgtcgtccctactactttagtaaccgatgctaagtcgtaaatcatggccgggtctaagccaatggcaaattcatcacggccctgattgccatgatagtattgattgatacctttaggggtgatcaagctaaacgacgccccgtaaatatcaccagcttcaatgcaactgtcaatatattgttcaattttttcgagcatccgcattacgcccacctttcactactaacacttattttcatctacttatcttctttatgataacgaacttccccacaaaatcaacggcaaaccctttagacacccatcacacccactcacactttttattaaataactggttaagcacttgttacattatggacaatattccacttatatatcaaaataagacgtttttcgacctctgattcaaatataattaagtgagttatcaatgtccaaattagcgtaagaatactttaatatcagcattttcagcaaaccgttcatacatgcttcacaaaaaaatcgggcaaacgtgaaataaatcacctgaaagcggttacaaattcgctaaaaaatgttatgattcaaatatagaattttatcaatcatttgattggattcaaattatggaggcgagaaaatgattacatcagaaaagacaacaaaaccagcagcttggaaaggtttcaaaggcgggcactggcaggaagaaatcaacattcgtgattttattcaaaataacttcacacaatacaatggcgacgaaagcttcctggccggaccaactgccgctactaagaccttgaatgacaaagtcttagaattaaagaaacaagaacgtgccgctggtggtgtgttggacgctgatactaaagtcgttgcaacgattacttcacacggccctggttatattcaaaaagatctcgaaaagattgttggtctccagactgacaagcctttgaagcgggccttcatgccatttggtggtattcgaatggctgatgacgctttgaaatcatacggttatacccctgatgaagaaaacgacaagattttcactgaatatcgcaagactcataaccaaggcgtcttcgatgtttatactcctgacatgcggaaagcacgtcactacaagatcatcaccggactaccagatgcatatgcacgtggccgtctcattcctgatcttccacgggtcgctgtttatgggatcgatcgtttaatggaagacaaagctaatgactttgcccacattggtgatggtgaattgactgatgatgttattcgcctccgtgaagaagttcaagatcaataccgtgctttagcagatatgaagaagatggctgccagttatggctacgatattagcaagcctgcaactaatgctcaagaagctattcaatggatgtacttcgcttacttagctgctatcaagacccaaaacggcgctgcaatgtccgttggccggattgatacaacgatggacatcttcatccaacgtgacttggacaatggtgttctggacgaaagccaagctcaagaattaattgatcaattcgtcatgaaactacggatggttcggttcatccgtactgaagaatacaattctctcttctctggtgacccaatctgggcaaccttatcaatgtgtggtttaggcgtcgacggtcaacaccatgtgactaagactgctttccggattttaaagactttggacaacatgggcgccgcaccagaaccaaacatcacgattttatggtcagaccgcttaccagaagacttcaaacgttacgcaactgaagtttcaatcgacagttcaaccattcagtatgaaaatgatgacttgatgcgggtacaatggggtaccgattattatggcattgcttgctgtgtttccgcacaaccaattgctgatgggatccagtacttcggtgcccgggcaaacttagccaaagcgattctttatgccatcaatggtggccgcgacgaaattgctggcgatcaagttggccctgcttacgaaccaattacttcagaatacatcgattacgacgaattcatgaagaaattagacaagcaaatggattggttagctgacacttacgttaactcactgaatgcaattcattatatgcatgataagtactactatgaagctgcccaattagctttgaagaatactgatcttgatcggacctttgcaactgggatttctggcttatcacatgccgcggattcaatctcagctatcaagtatggtcacgttaaagtaattcgtgacgaacgtggtatcgccgttgacttcaaagccgacaatgactacccacgttatgggaacaatgacgatcgagctgatgacattgctaaatggttagtcaaagaattatacagcaagatgaacacgcatcacctctatcggaatgccaaactttcaacttctgttttgactatcacctccaacgttgtttacggtaagaacactggtaccacaccaaatggccgtcaaaaaggcgaaccattctcaccaggtgctaacccagcatacggcgctgaaaagagcggtgcgttagcttcacttctttcaactgccaaattaccataccgttacgcaactgacgggatttccaacacgttcggcgttacccctaacacgttaggccatgacctcgaatcacggaaagacacgttagtaaacatgttagacggttacatgaagaatgatgggatgcacttgaacatcaacgtcttcaataaagacactctgattgacgctcagaagcaccctgaagaatacccaacattaacggttcgggtttctggctactgtgtctacttcgcagatttgaccaaggaacaacaagatgacgttatttcacggacattcttcgaatcaatgtaacatttaatctttaatagttaagaaggcgaaaggctcatggaaaacaaacaagtttcaacaacgcaagcggcggcaaaggagcctttgataggctacgttcactccatcgaaacgtttggctccgttgacggaccaggtatccgttacgtggcgttcctccaaggatgccacatgcgttgccaatactgtcacaaccctgatacttggaaactcaacgttggcgatcaaatgacggccgacgagattctagaagacgcggctaaataccgggctttctggggcaagacgggtggcatcacagtcagtggtggtgaatcactggtacaaatcgacttcatcttagacttgttcgaaaaagccaaggcgatgaatatcagtacttgtctggatacctctggacagccttttacccgagaacaacctttctttgacaagttcgaacgtctaatgaaggtcacggacatttcgttggtcgacattaagcacatcgattctgccaaacacaagcagttgacccagtatgggaacgaaaatatcttggatatgattcagtacatggcccaacaccacgatgatatgtggattcgtcacgtcctggttccccaacggactgattacgatgaagacttgaagaaactcggcgattacattgctaagattccaaacgacgtcgttcaaaaggtcgaagtattgccgtaccatactctaggcgttaagaaatatcatgaaatgaagattaagtaccggcttgaaggaatcgagtctccaacccaagatcgggtggcaaatgctgaaaagctactgcacactgctgattacaacgggtacaagacatggatgccattgccaaaactttaaagcggcatttctagcatgacgaaaacaccagcgatacgatcatctacggatggttgtgtcactggtgtttttttgctggccggaagttagtacggtggtacgcaaaaaagacgtcgcaagtctaaaccagcaacgtctttccttaatcatgccctatccaatggcagccaacccttgaactggctgctaacaggtcggccactaactatgaatccctagttccatccgcgcttcacgggacatcatgctctcattccaagcaggttcccacacgatttcaatctcgatattcttaacttctggtaatttgattagttcatcgtgaatatccttagccaaccattcggtcaaaggacagcccgcaatggtcaacgtcatggtaatttcagcggtcccctccgccgtcaattgtgcatcatagatcaaccccaagttaactagatcaattcctaattcagggtcaatgacatgtcctagcgcctcgaaggcccggtctttaaacgttgttgtcatcgtatctcgtccttccataccagcttgaattcactgattaatcgcgcaatcatctcgtcacacagtcgcaactacgtttgaatgcgcgccgcttagtgcataaagcgctttctttcctacttctattgtaccgtatgtccgcccatattcaatcaattattagtcctaattagtctacttttcaaacagtcggagaatccacaaatcatacgactatccttaaaaaaacatcggtaagaatccccggtatatcaacgtttaaggctgatgttaattttcattgcaaatttgcggttgtttttgttgtaagcgcttaccgtttatgctattatactaagtgaggaaaggaattaatcctcgattagcaaagcttctcaaaagagtttggctgtcgctgtaatgttaggcagcttgtatcacagtttgggtcgttatcgaaaccgttttaagcgccgtgaagcgttatcggtctagcgagtgtcgtgagattacgttggatgactgaacgttgacccttagataaacgataaccgcaaagaattaattggcattagaatgacgaacaggttttaactaagttttagttggaaacaggtgtctccgatgaccagttgttagttccacattaccagttccatttgtagactcaggtattacaaagtttaaacggaggtgcatgtctgttacgaagacattcccaagttttaaacgcgagtttgactttcgttaaaacccgtctaacgagtcgcaatcaagtaacaaacttactttagatcgactatagcagatagttacaataaatacgggttagtccgttagaagttggacacgcgtaaaattgaatagcatgaaggtgtatcatattaacactgaacaatttttcatcgctaatcaggattattcctcataagtagaactcaagtagagaagccttgggttctatttttttgccttaaaatcgaactagtccgttctcgtaaccgtttacatattcttgcgaaaaccgtatactgaatttaattcaagttgcacattgaggaggactttagttttgaaaacgattaatttaggtcacagtaatattcaagcttccagcgtggcgctcggcatcatgcgcatggatgccctgaatgtcgcccaagccaccaaggttatcgatactgctgctgatttaggcatcaattacgttgattcagctgatatctacggtggtggccaatcatcgaccatcttcggtcaggcgctcaaacaggctcacgtgacgcgtgatcagctctatatccagtcgaagggcggcatcgttcctggcaagcgttatgacttctccaaacaacacatcctggcagccgttgacggcgaacttcaacgcttaggggttgattatctcgacaccttcctcctccaccgaccggacgctttgatggaaccagaagaagttgccgccgcgtttgacgagttacaggctagtggcaaagtgcgccactttggcgtctctaacttcaatcccatgcaagttgacatgctccaagcggcactaaaccaacggctcatcatcaaccaactccaatttggtatcatgcataccggtgcgatcgactttggcttacacacgaacatgcaggacgaacgtagtcttaaccacgacggcgagataatcgaatactcacggctccataagatgacgattcaagcctggtcaccttatcaatacggcaacttcgcggggatcttcttagataatccgaagtttccagaacttaataatgccatgcaagcactcgctgatgagaaacaggtcacgaaatcagccattgcgaccgcatggatccttcgacacccggctcacttccaagtcatccttggtacgatgaatccggaacatctcgctcaaaacgctgccggggcggacgttacacttagccgacaggaatggtacgatatctactttgcagccggtaacgatttaccttaatcacgattgacctaacagaattgacaattagtttgactacccaaacgacgaccctaaccagtatcggttctcaggtcgtcgtttttttaggcgcagctttaacattttagacgtgctcgccacatttacgcgtatactaatcctatcaagactcaggaggtgagcaaatgacagctccttgcacaatctgtgaacgaatcaagttgatccaagcgcaccagaacccctatttcgtttgcgaactcacaactggttacgtggtccttgcagacagccagtattttgaaggctacacgctctttttagccaaacatcacgtcaccgaattacatcatttgccggcacacgagcggttacgattccttgaagagatgagcatcgtccaggaagcttgcgcacaggcctttcatgcggacaaaatgaacattgaattacttggcaatggtgatgctcacgttcattggcacctgtttcctcgtcataacggggatacgaccaaccccggccccgtctggtggacaccactagaaacgatttatggtgatgacgtcagccaggacaccccccgtttggagcgcctaaaacgcgcgctcagcatcgcaattaaagccacgctcaacactcggaaaccagaattggaagcgttacaggcactcacaaggcccgctactcgcgaaactgacggtaattagagcaaatcgggacgcaacccgcctagtttctcgtggtcgcaccctgattattaatcgtagtcagtctgaactcgcagtatacgccggaaaactgcctatttatccggccgactatcataagcccgcttggacttgtagccagcctgaaagaccgtcttcatgacctcaacgtgccgctccttagtcgcttgagccttggtcccgaaaataaatcgagcccattcacgctgataaccgggtgtcaaggccacaaaaaacgcctgcaactcagcatcagccgctaataattcggttactgccgggatatctttttcaaatgaactgaggggtgctgtactcataatcaagcctccgatttattttacttaaatttactgtaagaaagggaaaatccctaattttcaggcttttatatttcgaattttcacgaaattgcgctatcattatagtataagttttattatttgactaatataatcaaccatactgcaattcaccaaggggagccctgctatgccaaaatttgatatcactcttatcagtcctgagcgcgctaaagcgatgttgactgagtacaaagaacaacgaaagaattccgtcccgcacctggcccatcccggccgctacatcttaccggattacaaactaacccggcgccgggccgcattcaaaattgttaaacatacctttttaacgccccactacaagtcctacgttgccatggactctgacaatggccacacactctggtttcacaatttcggttccttaaccgaagcgttattttggttagaaaccggccttaaaatcagtgataccgactcccattctaactacaaagaatggatggctaagcacactactgaaatcgagactttcaaagacttgcttcgtgaacaaaagcataaacaggggcccaagactaagaaaaaagccaagtagccgttttgacatttagaaaagcagcagtccgctctgactagcgcggactgctgcttttagttatgatcaactatactattactaactaggccagcctaaaagtggctatccaaaaacacctgcaccttgcgcgcaatcacgcgatgaccagcatcattcggatgcaaagtatccaccgaataaatggctgcctgagcaggaacggcaaacgtcatccccgcatcatgatacaagctcaaatgcggaacaccataatccgcagtcacctgggcaatcgctgcctcataatctgcctgccgatatccgagaccattcgtcaccgcactaaagctacccccaaaatccgaaccaatatgaatcgccgaaataaacaacttcggcacggtcggccaattcgtctgcagtcccgtcaacaacaccgccaacgccccataaaatgtcgttatatcgcaatcaccgtattgccctaacggctgatcccgaccataatcattaacgcccccaaacacagcaataaaatcagcatcctccggaatatcctgatagcgtgccgccatcgcatcataacgactcccaatcgtcgaaccggatatccccaaattatcgctccgctcaacatcccaatcagccgccaaaatatcatgataatgcaccgtcgccaactcattatctgccgtaatcgaatctcccaaccacgccggccgcttaaaactaacatgcctattgctaatcgccatagccaatcctccccttactatctcatcgctatcattctaatccatcccacctgaattatggtagaaagatgcctttttaaggttggttttctgttcgtcagccggtgcgcgtcctattccgacctccggggctgggtaacaattgctggaacgtagccgacgtcgatttgagctaacgcacaacccgcgtcatctcaaatgcgagtcttattctaagccggaagaagagcacttccgactaagaataatttggctactgagcattgtcacccagcccctccggtcggtaacccgctcgaatggctgatgaacggccacttaacctgggtataattggtcgttcgctattttgatacgggaactttaaacgaaacgttagagttgtattaaccactttgtcgagatggtcaattattacgatgttgattgaggaatagtgagacatcccaatatcattttcatcctgacagttgactgacaaaattactgtttatgaaaaacaatgacaaattcatcaaaagttgggtacatcttcgtccgccattcgaacactgtcccgactggaaggcgtttcggccaatgctcagcggtgaaattccacttagcaagcgtcctttgcttggttagtggaagaccagtatttaagacgtgggcttcggcttaaatctgtgtccaccgcgttccagcaattggcagaaatgcctggaagtcggcgtagggcgaacgaactaagcaggtttacgctaacccgaactgtttccagcggtcctaagctggtggctgttgactttaaataaaggcatctttctaccattatttcaaacaggtgggccaatcttaaaaggctcgcattatggaaattcataatacgagcctagtttattgatatatttagttcgactgagtagcgctaatcggcttctgtttcacgtttccgtgcggtgcgccgttcgcgtgcgtagtcagttttagtcgtgatttcaacgtcacgtgctaaccgtttccggcgtgctaattcagctgctttggcattggctttcgcggcttccttgactggatcagtcgttaagtcgtgatggatcgagtacagtaagacgagcgcgacaatcgttaatgggaagccagacatcgcacagatggactgaatcgattcaaagccaccaaccgtgacgagccccaatgagaagactaggaagataacgacccagctcatccgattgaagcgacttggttgttcccctgcggccagctttttgctggtaaatgacgaggtgataaaggcgaatgaagaaaccgtcgttgccaagaagataaagcaagagaggcagtacaaagccaacataatcatcttcagtggtaacgtcgataatacggcagcaatcacagcggcttgcccttgcgtgttcaagatgtgaactaagttaacgatgcccatccgttgcaagtataaggcataaccacccaagatggcgtagaaactgacacaacctaatgagccccatagcaacataccaccgagcacctgacgaatcgtccggccccgggaaatccgggcaatgaataagcccatgactggcataaaggataaccaccagccccagtagaagatcgtctgccgttgcatggccgttgcgtgaccatttggtgcggtattcgtactcaaagtaatgaatttattgataaacaacccaatactattcgtttctgagtttaagatatacaacgttgggccaacaattaagacaacaatcaagaagccaatcgctaaccaaacgtgggcggcacttaagcggccaatccccttcttcaagccattgaaaacggccatggcgaagattacgaataatagggcgaacaaccctaactttaaggtcattgtatcggcgataccagtgacggtactcaaaacttttgaaataacggggatttccatcccgaccgaggtcccaacaccacccataatcccgataataacgagaaaatcaatcgtgttacgggcaatctgcttacccttaccaggaccttggagtactgaaattgcggcactgagccgctgaaccttgacgtgtttaacatacattgcataggcaattgcaatcgtggctggcgcaaacatcatccacgccattggtccccaattaaattgtcccagcatgtgcgcataattatatgcagaagttgaaaacggcttgacgccgaatgaagggctttggaggtaccgtaacgggtcaaccatgctcaacattaaaatgctggcatcgatcccggtcgcgtaaaccatactgccccagtgatacgttgaaaattctggtttgtcatcgggatcaccaagtttggttttccctaacttactaaaccctaagtaaatgaaaaagataaaagtgatcacatataccgacatataaagccagctcatgttatttgtgagccagttcaagatgccacttaaactcgtctccagcgaatgtccccccattaataaaacaacggaagccgccgcaaagagcccaattgttggtaaatagacccaccaatcaatattcttactttttaaaataataaacctgctactgagcatatactctctatatttagatcaaattcgtggttcttcctaccagcaacggtagtccccacgcgtaaatttccgactagcaatcggtacacccctccgagttaatcctcggagcactcagcaccctgactgaatcaggtttgaccggcattgtcatccgcattctgtttgtgctaactcaaaatcagtagcagaatttccttctttccgttggttgaatccggacaacgccatactgacaaatgatttttaattgcttaatcgacgttggtgttcatcttgtttagctagtgtttctattaccatcgtgcctttagcacacgaccgtcgtcacaccacgtaacgattaatggttacactgctcttgctaatagataacccccttgaatcaccagataagctcaccgcacaactgttagattaattgcttggtgcaccaaaaaagcgcttagtaccgggtaacgagttaccacctgcacagcgcacgttggcttatacaaatgctgatttcagtattttctgatatctgatgttcgtttataagtatactagtattaaatcagaagtaaaatcaaccattttgagccgtcgaggcctaacccatcaaggattagacgagttttacacccatattttttctgaaactttttaaaagttttcgtaataattagttttcagtttggaatcattcttatctgtttcaattaaaccgatttcatgttattcttgtaacaagtaaaaaaacgttatcatctaaaaggaggggaactgcatgcggcactactataaattaattttaacggtcagcgtcggtatcattgcggttattttacagtttggtttgcactaccaattggcaacacaaatcatcattacattaatggggtcacttatggccttatcaatgttagttgagatgatcaaaaccttacgttcaggtaagtacggggttgatttattagcaattacggcgattgtggcaacactagctgtcggcgaatattgggctagccttgtcgttctaattatgctcactgggggtgactcgttagaagattatgcggccaaaagagcgaataccgaattgaaagccttgctcgataattcaccacgtattgcccaccgctcagtcgccggccaattaacagatattgccgttgaagatgtccaaattggtgatcagctagtcgtcaaacctggtgagctagttccagtagacggtcaccttattcaaggaacggcactctttgatgaatcttcattaacgggggaatccaagccagtcgacaaacacgtcggtgatgacctgatgtctggtgcggtcaacggtgacagcgccgtgaccatggtcgtcgataaattagccattgatagtcagtatcaacagttagtcaaattggtcaaagaatccgaatcacggccagctaaattcgtccgcttagctgaccgctacgccgttccatttaccctagtcgcttacgtcattgcgggggtggcctgggcgttcagtggtgacccccaccgcttcgcagaagtcctcgttgtggcttccccgtgtccattgatccttgccgcacccgttgcgcttgtttcagggatgagccgcactagtcgtaacggaatcgtggtcaagactggggacatgttagaaaaactgtccacggctaagtccgccgcgtttgataagaccgggacgattaccagtggtcaattaacggttaatcaaatcgtaccccaacctggttttacgaccgaccaaattctgcaccttgcagcgagtgctgagcaaaattcaagtcatattctggcgcgttcgctcgtcaagtatgcgagtgccactaaccttagtcccaccacccagttagaagaagtcacgggcaatggagtcacggcaacaatcgagcaacggcaagtcaaagtcggcaagctcaagttcgtcgcaccggctacgaccaccaagccgcttgccactactgccatctacgtcggtatcgatggtcagtacgcgggctacgtcacgtttatcgacaacgttcgccccgaagcagcggccacgcttcaagcactccacgctgaaggcatccaaaacgtcatgatgctcactggtgaccaacaggcgattgctgatcacattgccaccgatgtcggtatcgataccgttgccgccgacctcctacccgcagataaaattgcccacttaaaggctgtgccagcgggcgaacgtcccgttatcatggtcggtgatggcgttaacgacgccccttccttggccgtcgctgatgtcggcattgcgatgggcgcccacggttcaactgccgccagtgaatcggccgacgtggttatcttaaaagacgacctcagtcgcgtagttacggcggtgcgcattgctaaagataccatgcaagtggccaaacaggccgtttggattggaatcgccatctgtacgatcttgatgttgattgctagcactgggatcattccggcactctttggcgccatgcttcaggaagtggtcgatacggtctcgattctttgggcgctacgtgcattacgggatcggccacaatcatcagtctcatcaacaaccacaactcccataacaaaggatgtgagctaaccatgccagaatggctcttacgatgggcacaatcggcactgacttttgtcgttgttttaacgttcgtttcagtcgttttactcaacgtaccactaaaagaagcaattctcgttgattttgcttacatgctattaacgctcgccttcgattggtaccgcagtcggcaccatgcctcgcgctaattattcaatctaatagtcactaacgatggttttaccaatcattaatcaaaaaaatcgttcccagatgtcttcttgggaacgatttttttagttaatgctcaatgcttcggtttagggtgagaccgtccacttacattcaagccttacttggccaacatataactaacttttacgtcgtccataatcgtggcaagtggtaccacatcatcaagcaaaattgaataccaatgtttcttattcatatgatagcccggtaaataatgttgtccatcaatcagcatagataagtcttctgggcgcgctcgcaaatctaataccgtcataacatgtgttgcgcccggcaacgccaatttatcggaagttaccgtcaataatgcgccataccatttgtgcgtgtctgagcgtcgccaaaccgcgttttgtggaaatttaggccacaagaactcaagatcgtcaccataaacagctttgacttgcgcaatcagcttacgctccggggtcgattggaagacgtcattatcgtaacaatgctgttcgatgttgtataaaacatcttgataggcctgcgctacttgacctacaaactgaccatgggcttgggatgtcaggtgtaaaacatatacttcactagtcgtcgtatccgttaatgtcgtgttcagactgccatcagtgttcaactcgattatcatttcaaattggccttgcataattaaagttcggaactgatactgaccattctgattgggttcaaatccaaactgactgagtttgctcatattgacccgtttattctcaaatctaactgttgccatctgctgcgcctccaacttcattcccacttatcctgaatgtgatgctcgactattgcaatccacaaacaagtcaacgcactcgttgtcgtttgatagccgctatatcattttataagtaatcacccgtaaagccaattcaattgaccattgctgtattagtaagccgacctttcacgacaattaccattgttccaatcagccaatacttgcgctaaagctcagctaatcttgaaaagacttcattaattcgtttatattgtttttttatacccgtccagccacaatctatggcacaatagttgataagtactggcaattgatgacctacttggttctttaaaccagcataacacaatcattttggctcgtggtattaacacatacatatcgttggttatgacctgaccctgtaccaaatatctttttggtcagcacagaaccatgtctgcgctgaccaatttactaaataataacggaggtcctaatttgaaaaaatatcgcgattatcgtaccgccattgcccgaacattaaccatgattcaacctaccgatgaaggcctcgccaagggtgccaaagcgattcaggaaatcttaaacctggcgcttgatcctgataccatcgtagattcggataatacacgcataactagactagccactagtagcgcacacaatgagaccagcggccacgctacgcaagcaaacgtggaagattcatcatcatccgtcaaaacaacttctgcacaatccaatgggcaaacaatcatgcaagtaaagcgcgatttaaagggttttgatttagtcgaccccaatgatccgaccggcacaccacgctaccactacgatgaaattttggcccgacaactggtgattcaccacgatgatcaggtcctgttagaaaaaaatttacggcaacatcgacaaccttatattgataaaatcgttagtcacgctactacagcggatccgattactgtcgcaccatttttcgttgttcattatcaagacaccgatgatacttatcacatcgaacaagattataacggcacaaccttatcgtcgctcaatccggcaatgaacgatgttacgttcactagtcaagaagcgcaatatcagcgcatcagtaatggtcaattagtcgacctggcttggtataaggagcggcctgagaaggtggttattcgttacgttcatcatagctcgagtcaaccgacctcgaataaagcatccaaaccagctaaaaaggccactgtccacacaaccaccgtaccagtgacgctacgcaccttagactttgatctgcacgaaaaaacagttgccatcgtcatgggcgacgttggtacgcgccgaacacagatcacgcaactcattgatgagcacaacgggcacaccttattgattgatgcttttaaacacagtaatagcaccaacttctattaccggcaaatcggtcaagcagacctcgtggtcatgattcagaatcagaataaacacgccacttccaaaacactgaataaagctgtcaagcattacggtattaaaatgacgattgctgatggcggcgggctgcagcagattgaacgagccgtttaccgcggaatcgctgatcttcccgcttatgagagtggcaatcccattagctacccccgcattaatgacgcttcacagtagcagccatttagcccattaaaaccacagtaaaagccccgcagcagctaactaaaacgtttagctattgcggggctttaaacatatttcggcacaagccttaaactacatcgttgttcagtagcagacacatcatagcctaatttcagtcaccgaacgattgtacttaaactgtttggcgctggttatcctgaatcgcaactggaataaagtcaaaggtcgcgtaatcgaataacccccgtgccgttaacttcaacgttggaatcacgggtaatgtcaaaaacgatagcgtaatgaacggatcaaagctaagtggccgctcgctaatgacctcatacgctcgtttaagttcggccaactgttcagcaactttttgatagctcgctgcagacagcaagcccccaatggcaagcggcatggtcgctagcacttgttcattgtcaacgaccgcaattcccccgttatcttgggtaatctgggctaccgcccgtaagattgcggcatccgacgttccgaccgcaacaatattatgagcatcatgtgccaccgtaccagcgatagctccctgtttaagtgcgaagccatgaactaagccgacgcccaccttgcccgtgttatgatggcgctcaatgacaaccattttgagaatatcacgttggcaatccgcttcaaaattctgcgttgcatcaatcgggagtgttaagtgatccgtctcgatatggttcggctgcacaccaattacatttgccaacccggtcgctagtggtaattggaagtcggctagttgtgcatggtgctgaacacgcgttgcagtaaacggcaatggttttgtcgtgcttggtaatatccactgtccccgcttcatcgtccgcgcaatcctaacgtgttcgagatcatctaagaccactaaatctgccaactgcccggctgacagactaccccgatcacttaaacgatgcgccatcgcgccgttgagactagccaatgtgtaggctagttcaggacgcatcccgctctgcatagctaggcgcacgttataatcgatcgacccttctgtgagcaagtcactaatcgtcttatcatccgtacaaaaagcaaaccggctagcattagcttcggtcactgcaccaatcgtcggcaaaacatcgcgttcaaccgtcccttcacgcaagaaaacagccataccagcccgcacacgatcctgtgcttccgccactgtcatacattcatgatcagtatccagtcccgcattgcgcatcacattgagctgatgcgcattcaaaccggcagcgtgaccatccgcatgatagccatacgcataggcatcactaattttagccagggtgtcagtatcaccacgcgcaacggccccatagtccattacttccgccagtccccgaacctccgactgttggtaaagtgggcgcaagtcagcagcatgtagcgttgccccgttatcatcaaagggaacacacggtaccgatgacggtagcataaaacagacatctagtggtgtttggcgcgcatcatcaattaggtactgaatgccagcaatacccgcaacattggcaagttcatgtggatcagtcgcaattgtcgtgacgccgtgctgtagtaagacttttcccaactcgctaggtgccaccatcgaactctccatatgcacatgtgcatcgatcatgccgggaacgatccactgaccggtcgcatcgacatgctgggccgctatgtacggctcgtcacgcaagttactaataatccggccgtgatcgatccacaaactggtggcttcaaattcacgggtataaacgtttaacacttgtgcaccagtaatcaccatttcaactgtcttcgtcatcgttattttctcctcactagtcagtctgcctacggagaaagcaaacgggtccacacggcaaattaagcagtgtagacccgtcgactcaattcgcttatagtccagtgtttacggcactgggtagaaactcgccatccatatcatggcattatataggcaattagttgtattgataaattgttccttactttaccagccttttcagttacatgcaagccctaattatcataaatgattggtacaatgaacttagaactagacatgaatattcacctaaatcaatgtcgggtctgccacaaacagcgctggcattttaaatgaacggcatacgatttgcgacaaggtcccttactggtgacgccatctaaccagaatgctgattaggatgttgttctgcgtacattgaaacgcaacatgttccgataatggcaagcccgtgaataaaaccgtcggccgttaagtcgtcttttataatgatttgcgagcagtcgcctttgatttaaagcggacccgctacgattaatcaacagtcatatttttaaacattcttttgctgactataagttcatttacgtttacaataaagctaaattaatattaatatacataactattttttaggagctgatgattttgatgatgatgaataatccgaccatgctctcatacattcgtcgggaacagccagtactagagcggttgttaaccaattatcccaaacagattacggcggccttgactgccacccctgatcatccacaacactggttgatcctcgcaactggttcaagactcaacgccgccaacaccgcccgcttatacatgcaaaagacggccgccctccaagtgaccattgctgcggccgacctctacgtcacttatgaggaagctgatcccagtgtcgatgttgttatcgggatttctctaaaagatgatgatccaaccatgcaagcggcaatcgaaaaagcccacacggccagtcaagctcatgtcattatcgtgactaatcaaaaatcgactgctctgaccgcaatggccgatgcaacttgtgacttactaactggcaaagaatcagtgccctatattacactaagctttcaagccatcgtgctcactttaatgttgcttgccgtccgcagtgctgcccttcaagcacggttaaccgaattagcagtcaatcaagaattagacgagttcagttttctgattgaaagcatgaatccaactgttcaacgggcgaacgacttctaccgtaagttcactattgatttcactaacgcccctcaatttacagctatcggtgctaacgtcctagctggaacactaactgaaatgcaagccaaattcaccgaaatcctccgggtaccaacgcatggttactcattagcctcatttacccacggtggctttatggggacgcatgaagatcactgtcagttctatcttgaaatcaatacagacccggctgtcatgacccaattacaggccgtcaagacgtacgaatcgcgattaacgccccacatttataccatcagtctcactggtgaccaaccgaccgtcaatgatgatcaaaccctccagctcgaagccgttgctgatccgtataaagccccactacttgcgattatcccgttccaagtcttagcttggttcattgccaaatcacgcgggatcaatttgaaccatcccatgtacgcagattttcaagcggctactaaactcaagtaaagattactaaatcaacgcaaaatgaccagtatcgatattcttcgatactggtcattttaattaatgctcgttttccgtaactgcgtaataccgaattctcttatgttgacgctgtgcatagccaatttcttgcctagtccgctcaccaatgtagccagcaacattaatgaccactacttcatctgccaagtcgatttttttcaaatgtgtctggcgtaaattctgaagctcaatcggtgttaatacttcatcactgaaagctggctttaaaacaataacaccttgtttactcagagccagctcaaccgtttcaaatactgccgcatattttctagacccacataaagtaactattttaacagtcattcgtcaaccttccctaaagtgaactgatcgaccaacgattaaacctccgtcgcagtcacatgcttagttttcactgcagtttgctgattcaagtgcgccataccaacaccagtgaaaccactgattaccgagataactggacaaagtaaactgaagaaaacaaacggtaagtattggacggtcggtactcccagcgtcgtcgtcaggaagacgccgccaacgccccacgggactaggtaattgattaccgtaccgccatcttcaaggacccgccccagtgcatttccggataagccaccatcattgaatgcctggcgaaaagcgcgccctggtaagataatcgaaagaaattgttcaccaacaaacacgttgacaccaatacaagttaatacacccgccaatactaacttgccatcgctattcaagtgcttagcaaccggggtcataatttgattgatcagtccaaacttgaccaacaatcctcctaaggatagcgtaaccacaattaacgcgaccatactcatcatgctgacgattccgccccgtgaaagcaacgtatcaacactcgtattccccgtcttcgaaacaaatcccgtgttaataatggcggttaacttggtcattgataatcctggttgttcaaataagatcaatccagctgaaataaagatatttaatagcatggttggaatggctggcattttaaacccagcgcaaacgaagactaggacgattgggagtagcgccaaggccgaaatactgaaatgaccatttaaaacggcgaccgtttgattgattttagctaagctggtctcagtgctgctgtgccccagcatagcaaataatcctaatgaaatgaggccagctggtagcgtgctccataagatatgcttaatgtgcgtaaaaaggtcagtatccactacggctgaagctaaattattggtttctgataacggtgataatttatcgccgaagattccaccactgataatcgcaccggcaactaaggccggattcagattcatagtcacgcccatcccgaaaaaggcaattccgaccgtcgatgttaccgtaaaggcactgccgaccgccgcaccgacgagggtacaaacaataaagactgatggcaaaaaccactgaatattaataattttgaatccaatcaccatgagcgtgggaatcgttcccgctgcgatccaagttgaaatcatcgccccaatgagaataaagatgaagattggcacgattcctttatcaatgccctctttaatcccggcattaactgctgaccacggaaaaccgcgcaacatcgcccaagcagtgacaacacccattgcgagtaatacgggaacttggggcgataatccccaaccaatcacacccgcactcataattccgaggacgaccagtaagacaatgactgcttctaaggtactaatttgtggtgcttttgttttgttcataatttattaccccttcgattgataaaattccagtgacgcatattcatcattaaaattttaatatcgtgcaatcccaccacagcgttgatttgtcattattctcatcctcttcatcaaaaaaatcgtccccattgttcatatgaacaacagggacgattagactagtcgcggtaccacccaggttgcggattattgacacttaatccaccactcactagaagataacggttctagttattatccgttcagtcgaaactcggttaccgtatttcaatcatagtagctgaccggttcgcagcaaccaccggcttcctgacacctaccactatgtctacttgatgtaacgttatcgtacagttattaacttgtgattaacaataccaccatcttttatcatcgtcaagccattttataatataattctcattttaagattacgaccgtgttacagctcgcaagcgcgcttggtgggcaaaagtgatgccaccaaatagtaacgtccaaataatcgcaccgattgcaccgacaatatcagcttgaatgaagaatagactggcaaaaataagaacaaaaaaggcaatcgtcagtgggctcgtgattcggtacgccggcatcttaaacccatccgccagatagtcattagatagccggtacttccgatgggccagcatcgccagcgtgtaaacaatcaggtacatatcactagagatcccggtcacgacggtaaaaactgccgtcgttgcagcacttaaactcatgatgggggtcactagcactagtatcgcggacaacacgattgctgctgccggcacaccacttttcgaaatctgaccaaagatttggtgcatgcgactcgtaactggcatttcagtggctagctgatagaagtgacgtccagctgagaacaaacaactatttagcgatgaggctgccgacgttaagacgacaaagttaatgatggcggccgctgctgggtaccctgccaacttgaagacttgcacaaacggactgctatcgggtgacagtgacgtccacggaataatgcccataatgacaattaacgcaccaatataaaacaacaaaatccgcaacaaagtttcattgaccgcctttttgataacgcggtgagggttcttggcctcaccaatcgttatactgacaaattcaatgccctgaaaagcaaagaagaccattggaaatgccgagataaagttagctatcccattgggaaagacctgataattatggaacaaattgccgattgaagcctggcctaatggggttgggtgatgtcccaccatcatgaaaataccagtgacaatcagtgcaatgattgcgacgatcttaatcatcgcaaaccagaactctgcttcgccaaataaccgtgcagccgttaaattaacgcccgccaaaattaacaggaagctaatctcaattagccaggcggggacatttggtaaccaaaatttgacatacgttgccgtagccgtcagctcagccatacagacaaaaatcaaaccgatccaataggtccaccctgtaaaatgaccaacactcggtcccaaatagcgggaaataaacgccacgaatgtgtgttgggtaggatcagaatagaacatctcaccaattgcccgcatcattaaaaagaagaagaagcccaacaccaagtacacccacatgactgacggtcccgtctttgaaatcgtactccctgaaccaagaaataatcctgtcccaatcgtgccaccaattgcaatcatttggacatgccggttactaagcgcccggattgtgccatcagcattagttattttcataagacccctccacaaattttaatgactttgttgctaaaatttaatgttgtgtcattatagcacgctctagctttcacttaattgcgatttttaactgttaacccctgtttttaacgacgaataggtcgcaatactttgttttctaaagctgtcttccttattgaaaacgtcaccaaaactgtagttgctgcgtttgaccgcctaatttggcgctacgaaaaaagccgcccgagcatttacccgaacgacctcatttatttaatgcactcatcctgacacaataacacttaccacaaaaaggcaatcatcttgtgagcgacacttggattctgattcaacgcgcaatgcgccgcctgttccccactatagaaagcttcttgatactgtgctaattttccgcgcaacaagtaccgaattgagcgcgctgaagcggcacccacaaaaccatcattgttataccccgtgtttgtatctccatagacattgagtagtttcacgttgtctggaaaattgtggcgatacttgagcatttctgaaaaatgcttcgtgaaacgacttggtttaacatccaagcgccggaccgttgcttccgtctgcgtgctcagaaacccggtcaggccatcgaacggtccgccaatcgtcacgattttattcaacgttggtaagcgtttgtcatgcccatacttcaatgcctgattgacaatatcattggccccgagggaatgaccaaccgcattataagctttgacgccatacttcgcttttagttggactaagacttggtgtaaccaatagatctgggctttttgtgaggcgtgattatcttgaaaaacaacttgaaccatcggattcttgattgacttttgccaataacccttaaaggccatcacaccattcttgtacacgtgcaccactaacgctttttgggcagcccccgctttttcggctttacgaatcagatagttcgtcgaatacgccccaccattgtagccatgtaaaaagaccgtcgctgtctttgactggtcatattgattctttaatattcgtgcagaacgtggtgtcaattgactcgttactttcgtaatcttggtatcatgattccgggccccaactaaaatcacagccgcaccgataacaaaaacaatcaataacaattgaatcaccgttcgccaacgtttcatcaaaattatcttacccttcattatgtttaacagtcttattttacgcgtttcaattaaaataaccagtcatcgttttcaataatcgcctttttaacccgcaccaacgaatattgaacccaaatcatattctttagccactcatctcgttataatggacttactaggttaaataactaacctactcaaattgtttatttctggagggtaactatggaaaaaccaacgtttaaatatcctgataaggctgcgtatgagttcgtcattcaagccttagccgcaaaagggattacttatcatgaaattgcgcatatcacttataacttacaaacaaaatacgtccctaacttaacgatcgaagagtgcgaaatggagacgcaagaagtactgcacaagcgcgaactattgaacaatgcgatggttgcgttagaactcgaccgccttgccacagaaggccagctaaacgagccgctccaatctatcattgccagtgacgccggcgtcttcggtgttgatgaaggcttagcacttaatatggcgaatatttacggcaccatcggcgtcactaattatggttacgtggataaagttaaagaaggcgtcattaagaagttagatactgataagtcaggcgttgttaacacgtttattgatgacctagttggtgcgatcgcggcggccgttgcggctaaaattgcacataagtatgcctaagcattgtatttgctagtcgttatcgcttataaaaatcagcaggcatcctacttcaatgcctgtttgcttgaattagctagtctgtactggatatgtccgctaaaaaacagttacctcaaaatgaggtaactgttttttgggctatcttcaccactagattaaccaacgcctgccaaatattctgcctactcctcgacctgactactgtaattgatccgcataatcccgtaagtacgttgtcatcgttcgtggtgcatgtcccagcaccttttcagccgtatcggtcacacgttttgcgttgcccaattgggtaatcaaatacagcatcaccatgacattaacttagtcctttttgatgccccgcttcaacatcacgcggcgaaaccgccatagactcggccgatgatatgttaccgggtgaccaaaggattcagtcattagcgccgcaatttgctgataagtcagcgcttctggaccagtcacagtcaatttttgttgtaaatattgcgcgtccaataatgccacacccgcaatctcgccgatatcgcgggtatcaataaaactcgtcttcgcccgcccagctgggataaacaaatcgtgattttgctgaatgtcgacgcggtgcgtggtattcaagttctgcataaagaagctcggttgaatgaatgtgtacggtaactgtagctgttcgatcatctgctcgatttgatgatgcggcgtcattggattatgctcaacgcccatcaacgaaacaaatacgacctgctcaatgtggtgtgcttgcaggcatttgagaaaaggccacatatcttgcttgggtttagcgagctgtggtggccgcacgaaaaagacctttcgaacaccgtgtaacgccgcatcaaaggtcgtttcatccaaaaaatcaaaacgtcgaatttcgacgtccggatacgcagccaatagttgctcgtctttatgtaagttgtgggcaccagcaacgacttgcactcccacctgttgatctagatattgaattaacggtaagccaatatttcccgtcccaccaatcaccagtattttcattttattaatcgctccctagtttttttaacagttgtcttaaagactgtttttcagcagccgtcaatttctgaagccccgtcgcaacgacctgatcgctaatatgctggccggcctgcaattcttgtatgccaacttgggtcaagcgtagtagctttgcccgctggtccgctggattaacttcctgttcaaccaattgcttggcagctaagcgtcgaagaattcctgacatcgtcggccggtccatatcgagaacgtggcacagctggttggcagtcggctgttgcgccgttctttcgacccaaagactgatttgttgcatcacagcccattgttgaatcgtcaatccgttagcaattagccgttgatttagctgataacgtaactgtttggaaaactgcattagtaaataaccaatattatccattttaccctccactatttagttagtatactaactaaatggctgtaatttgtcaatttacacacaaaacagcaccgcttaactgtgccaatcagtttatactggcaagtaagtagtactgttttataatgtttcgccccaaaaacacggcatcaactcataagccgattattttaagccatctgatgttctgacattgcttgcatcttgagtacgcgctgttcacgtggaataaacatccgaatctcatcttggttaaagccgcacagaagtcggtgatcgtcaaaaataattggccgccgcaataattgcggtgtttggcttaatacccgaacagcttcgcttaatggcatatcttcaatcggtgtcgtcttactcagttggtgataagcattggacttagtactgatcaaatcatcaatgccattgtacgtgtactgtagcaggtgcttgatttcagtctccgttaacggctgtgcattcatattacgttcatgaaacgggatccggtgttcgagtaaccaccggtgggccttgcgacaacttgcggtacttggtaacacacataagtttatcataaaattatccccaatcttgcttgcctaacaatgcagcccccattattgtgcactgtaatagttgacgtcattaattaacaacataatcatagcaaaattcgtagctaattgctagcgttttcaaaaaataattaaaataatttgatggtcgcagtttattgcaggcctaatcccaatttcatctataccaatattacgcaatttatattaagcggttggtaattgaccactatccttcaggtaatcacgcagtaccactgcctgattatgttgttcgtccttggcaccgaacaataagatcacattcgtcttcgtcagttgttcagcaacttgactaataaagctggccgtcaggggattctcatccaattcagcccggtaacgatcgacaaattcgggatatttcgccggttcatgattgaaccacttacgtaacgtggtcgacgggccaatttcctttacccaattgtccaactgagcgttaaccttcgaaataccccggggccacaagcgatctaccaacacccgataaccatccgtatcaactggtttcgtgtaaatccgttctaattttaattgcataatgaacactcctcctatcgtacgctgcggtaaacaatctataaccatttacaataacctatcacattgcatgaccataagttgactccattataacgcaggtgccggtatcgttaaatcgaaccaacactttcccgcaaccacatattgattagtcctcatgacagccactatcatcaattcagtacaaaaaaatcaggtcccacgaatggccctgattttcatcacaatgagttgactaacatcttatcatggttatgacaatcacgttagccttcaccgatcacaacttcaacttggccccttttcggcacaaaattaatgttataaatcggttctcgcaacaccttttcatattcttctaagacatcttgtggcaatggcgtatgggcggccaatgcgcgcattaagtcatcgaccgaataaacatcttccatgttaataaagatccgcatatttcccacaacatcattcaataattctgtcaaaatcgcattgggcttaccgttaccatctgtaacaaccacttgattactgtcgacttctttatggtctatctttgttaacttaacgatatcaaatacatttaacatgcgcgaccctccgtcacaatattgatttgctatattttaccacaaccatagcacatctgaagggtgaaaagtatttaatgttgactgaattaatcaattgaatagcgtgcaaaaattttttcttgaaccttaggcattggaagtttctgcctctcaatcaacgtaaaggtctgaccagcaaagtaggctgagtcacttaacccaacttgaccactcaaaccttgaatggtccacttctgatgcgtaaacgtatgggtcacaggccgcccggtcagataatgggccgttagctggagctgatattcacgtttaaaataattttctaccgccgtaactagttcttcaggttggtaatcatcatctaagtctaaatctgcaatcggaatcaagggaaccgtccataaattagccaacatcccgttactcggtcgcttcgtcatcaaccactgatcctgcatcttagctaataccgccacgtaagcaaccggcttgggccgcggtttcttcgtcttgaccggataggctaactcatccccatccaaataagcttgattaaagcgtttgaccggcgaatgagccgtatctggttgccgcgctgtcatgtagcttgaaccgaggtccataatcgcctggttaaaatctccaggtcgctcttgtgaaataatctgactgattacccgttcaaaaacagcgcgggtctggggcttcgcaatatccgcatcaatcttgagcaaccggctaaagacgcgataggcattaccatccacagctggaactggttcattgaacgcaatgctggcaatcgctcctgcagtgtacgggccaatcccaatcaactccgtcagctcagcggcagtttgaggccactgtccatcgtaatcggttaacaattgtttggcacaccgttgcatattgcggacacgtgaataataacccaggccctcccacgcctttaacaactgtgactcaggtgcggcagctaggtccgctaccgttggaaaaagtgccataaagcgctgataataaggaatcacagtttgaacctgcgtctgctgtaacataatttcagagacccagacgtggtaaggctcatggtcatgtcgccatggtaaatcgcggccttcgtgatcaaaccaatctaatagcgtcgtctgaaaatctttaattgttgccgcatcccattcaatcattactaaccctccaaaaaaggccacgaggcttcgtctatccgaagttcgtgaccaccttatttacaaattaatccaaagtgttagccaaatctacgagtgttttttcgtagtgatccgttacactttcatcctggaaatcggcattgaaaacggccaatgtcaaatactcggggtattttaagatgaccgctgctagccgcttattaatatctggatatttttgatcttcattattcaaaatatccagactcgcttggtaacaaacattggctaaaaacaaataatccacaaaataattaaatcctggttcgttttttaattcaaaatgcgccttcacgtccactgtttccgaaatattcgttaaatacttcgttacaatttcttgatactgacgtaacaactccgcctttgcttctgcatgtaccgttgccataaaatatccccacctaatttaatctctgtgaagattatagcatacggcgtaacccctgctgaatgttagctgctaatccagctaactgatcgtactgccactgacgctcggcagtgaccgcaaccatgtcatttggttgcgttaaattaaccaatttaattgcttggtccgaggcccgcagcgcattttcatccgcatctgcggaagctacggcccagcgaacgcagtccagtgccgccgcgccaatggaactcgtcgtcgttgcacttaacttagtcaatcttgtcagtgcctgccgtacctggtagccactaacaagattaacttgccacaattcattagcatcaattgcgagtcgcaattgtcgatcatatttctgttggttatcaacatactgcaaggctttcttggcgataattaacgcccatttagccaattgttgttgtgagagttcaccagtcaaagcttcgatttgagcccgtattccagggtcatcgtcaatctcaatcttagggtgactcggtctaaaaccttccgtcatcacgcattcctactttcttacaaatccgacaacaaacttaccctatcgttaccaatattcagttcgattgatatatcgatagaattaaattgtaccagaaattcagcaaagatgtgagtatctgcctccagatttcatcaaaactttacaagcttttgtaaccgtttcatttgttgcaaacacaatgaaacggcgacccaccaccaatcgtggtaagtcgccgcatgagtcattattgaatttcaatatggtgcgtatccgcagccgccttctttggcaaagttaactgcagcacaccattttcataccgtgcttctactttgtcgacatcaacgtctggtaaagaatattgccgaccaaagcgaccggtttgacgttcactcgcgataatattaccatccttatcgctttcatcactaatactatctcgttttacagcgatcgataacgtgccatcccgatacttcaacgcaatatcttgtttatcgattccgggaacatcgactttcatcgtatactgatcgtcattttctttaatatcagtctttaaaaccgaaccatggctaccagggtttaagaatgtccgaccgagtccattaaccaaatcgtccatcttagtccaatcattcaaccgatcaaataaatcattgtgccaattcatcatatcgttagccattacgcaatcaccctttcaatttgtttacatcattaataataggcccttttatcaagattgcaacaatttagcactctcgatgctcgagtgctaatcattccacttggtacgcgcgcatatcaactggaatcacccggaccattttatgtggtgtaatcgttaacgcctgggtcgtccgctttgtcggccagcgagactgcggacgatcagccaattctaggccgaccaacattctaattcgatctagaatatcaggcaccccaaatgcattattaccctgattgaatgaagtttgaagcatattaatggcaacctgtaagcgctgatcatggaagctaaaggtcactggcacgtacaccagattggtaggcggtaattgttcttgcgccaacgtcgtatcaagctgggccataaacgctgtaaattgatccatttgcgtcacccccatcattaattaccgctattatactgcaagaccgacgtgacagctattcaaatggatggcaatcatcgcatcactaacaaccagccgccaaaatgctagccatcaacggtcattgccggtaataatcgggcttctgagggggccccgcactcatttttggcaaaataaaagggcgcgaccaacgtctcgccctaactgaagaatcacgctaattattagctattagataactttttagcatcttcatcgatcgtttcgaaaccggaaacgccactcttcttctttggatgctttgcacgttcttcttcggctttttgaatcatagcctttttttgttccttgctaagcttttgtgccatgattatcgcctcttttatcttggacagcgaagtacaacctcgctacaacttcattataagtctaaattcaaaaagtggcacaaatttgcttaacttttttgaaactgcttacttgcattctgtaattattaagtttacagttaagttgttcaggaggggattatatgacaaaagtattgatcttaggggctgcgggccagattgctcgcttagccgaacaacaatttttagccaacacgactgataatctgacactttacttacgtaatagtagccgggtcgcggaccaacaatctgaccgggtgacgattatcgatggtgacacgaccgatgaagctaaactaacgcaggcgatgacggggcaagacatcgtttacgctaatctggctggtcaaaatatcaagcagcaggccgaaacagtgttaaaggcaatgcatgctagtgggctcaagcggcttatttggatctcgactttgggaatctatgatgaagttcccggcaagttcggtcaatggaacaacgcgacgctggggagctacctgacgcgctactatgccgcagccaaagttctagaagattccaatctcgactacacgatcattcggcccgcgtggttgaccaataaagacgaaatcgactacgaaacgacccagcgccatgaaccgttcaaaggaactgaggtttctcgtaagagcatcgcagcactcgtcgttaaattagcacaagatccaacggacagtgttcgcgcatctttaggggttaacaagcctaacactgacggtgacaaacccgcttggtattaagcattgcacctgtaaaaaactgtaaaccgacaagcagcaccgcgacagctaatgccagtgctgcttttgttgtgccttaatttatgagaaaaatgataatatctagatagttaactaacgatagctgccgatcaattgatcaatttactgatataactaacaactcgttctcatgttttcttcatccaaagcagcgctcgtaactgctgataaatcgcgggtctttgcagttgacggtcaaaaatccaagtgttaaattatagactcaatttgaaaataactggcgatattcttcagttttcaaggaggctttcacttgaatttgaaatggtacgttaagcaatttaatggtctaaccaccacccaactgcatgatatttatcaacttcgcgccaagacctttgttaaagaacaagcgcgatcttatcaggatcccgatgataccgacttggatgcgcgacacgtattcgcttacgatcaaggacaactcgtcgcttacgcccggatttacgagcatgccggcgtcgtttcattcggccgaataacgactgacagttactatcgtgggaccggccttggtaaacaactcatgaatcacgtcatggcgattctcaaggtccattacagtgccgccaccatcgaaatcgatgcccagacacacgcccagaagttctacgagaagttcgggttgattgctgaaggtcaaccctatactgatctaggcgccgaagtcattaagatgcacgcccccgcccgaaaactggtgttagcgtagcacggcttgccaaccatcaatatgcaagataactttaatccacacacattatgattaaagctgcgcatcagaatactcaattctgacgcgcagcttttatttttggtcactttacaaattactgatattttttcaacgaccgcgctaactaaatgcgagccaattgctctcattactaaacgctagtgactaatcactagccggatcacttcgatactgctgcaagatatagatggcaacaatcaccaacaatgagccaaggatttcgacccacgtcacctgtaaacctaagaagatgatacttagcacaaaggtcaccactggttgaacggcatcgacaatactaacgaccgcggacggcgcgtactgaagactatgcaatagtgataagaaggcaaagatcgtcccaatcaacacgatggcgccgattgaagtcacgagcgttggcgtgattttcggtgccccgacccaaatcgggtgatatagattaaagaggattcccgcgatcaatgtcccccagccgagaatcacgaccggcgaattttcagcaacgatttttcgtggtaagaccacgtatagggccgccgttacccctgaaaggacgccccaaacaagtgcatccatcggaatcgccagttcgtgaatattgcccttcgtgattgctagaaacaccccgagcagagagaccgcgaatgcaatcagatcagttcgtaagggtagttcccgtttgaacagcagtgtccctaacacaataaataagggacttaggtattgtaagatggtagcggcagcggcggttccgcgctcaatactgatgtagaaagtatacatattcgccatcaatcccattgtcgcgtatgcgactaattggccaaccgacgcccacgacttaaaaaccttgaagattttggtgccctgttgcacaaatccaatcgctagcagaatgattccagcggataacgttcttacagataggaaccaatcagctgggatagcttgattttgtgatacgaactgcatcaccgtccctgagataccccacagggtcgaagccaacatcgcccacatgatgcccttcatataccggttagttgtcatatttttcaatttcgctctacctcaatttaattaatggcaatattataccgggacttaattaaaactcactgaaaatcgtgcgttgttttttaggaagattcagcaatctttatcataattacgttctatcagctaaaagcaccgctaaacccgaactttcatcactcattatatgtaatcacacggaattcacacgccactaaataaaactgggtcggtaaccacagcggttgaccgacccagttttatttaaatccgtccctaagttcctaacaatttgtgcccatcctgatgccgtttttaccacaccgtatccccataagaccggtgtttaatcgccgacaagtcgtgcttagagcaagcgacttaaaagagcgtcccaacgtagtagtgaatgaacatcgtcacgatcccaacgagcacgttgcgaatcaccgccgtcttcacattgcccttacctaatacggccgataaatatcctgttaaggccacggcaacggacaccgcgataattgttgccggccactgccaatgagccggtgcaaacgtcatcgcgagcaacgggaagacgcctcctgctgacgctgagaatagcgatgcaaacgctgcatcccaaggattcatatagtgtcctagttgcatatcatatttgatgctgacaacggttgccaatggttttttagttaataaatcgcgtgcaatcgccatcgccgtctcttccgtcacgccaagagtcatatagtggcgttgaacagcatgcaattcaccctcaaaatccgtcttcagcaattgccgctccttttcaaccacggctttttcagtgtccttctgcgtgctgaccgaagcatattctcctgacgccatcgaaaaagcacaggctaataaatcagataatccagcaataaaaatcgtgaactgattagtcgtggcggccgccacactaaacagcacccccacaacggttaaaataccatcattagaacctaagacacctgctcgtaatgagtttaacttctcatccatcgtttgtttggtcttctcagactttgtccttgtcagttgcataagctcgctccccttgaccctttaattaagcaaataagtgaccaataaagtacgttacgatcatcgtcaataacccggcaacgacgttacgaaccattccgcgccgacgattagcattacccagcatcgccgcaacgtatcccgtaatcattaacgcaatcccgacagccaataccgttgctagcaccttcacccgtggcgggaagaaagtaatcgaaactagtggcaaaatcgaaccagtggggaaagcaatcattgacgcaatgccagccgcatacggactgatgaattggttcggattgaagccataacgttcacgcaccgtcgtggtcaacgcatcttccgccatcatttcccgggttgcttgttgcgccaacggtttactgattccttgatcgacatatttttgtacgactagcgacgcttctgcttcataatcatcggcaagtgctgccttctgcttagtaatcgccattttttgtgaatctttttgcgtattcacggagacgtattcacccatggccattgaaatcgtcccagccaacatcccggctagtccagatattaaaatcgaaaaactattggtggttgcccccgcaacgccaacaacaatgccggcaactgatagaataccatcattcgctcccatgacacttgctcgcaaaatattaacccgctgtgccaaagacatcctttttttcatgtttgccgcctccgtagatactttataatcattattacctagtaaatattatatctttcagaaagaaaatgcaaggcttatttgtaatcattatcgagtataagttatgtatccctaaactataatatagtgtaccaccatttaattattaaagttaatttgaataattattataggtcattgaaagtgctattctgcctagaatcaaaaaaagcagcaccgttagcattttatgctaacggtgctgctttcatattttgaccctaatatattccaacttagtttgctaaccggaactgttgggttgtctttaattcaaattcagtcggttgcgcggccgtcattaaagctggtgtcaattcgacccgcgtaatcgtctgatccgcgtatggttgcatgtaaaatgctggttcattcatgctcatataggcgcggtactgggtataatctggcgtcccgttatcttgcatcttaacgcccttaggaatctccactgagttcagcatgtgtgataatgcgttgacagcttctgcatcagtcgttactgcatccgtatgttcacgcatgaagaccgtccgaacgaagcgtgcaactgacgtatagtcaccaggcattcccaacgccccagttccaggaccgaaaggattcaccgtcatgtcaccgtattgacgactaggatgagggccgggttgtaagttgacgtaattactcaaattcttgagatgccattcaaaatctggtgtgttcgtcatgacgcccaccggattcttcatgtagtgaacaccgtcattttccaattctaagacgtaagtagaaccactcttgtcactaatgatccagtgtagtggtaccacaatattcaatagtggtgcggcggcttccatcacgttcaagtcagcaatccgttcgcctaattcagcggtgctcttcacgtttcctaaaatccacattaaaacttcgtggggtgccaagttaaccttgccagccttagtctgctgagtaaagtgagcttgtcccgagaaatagagtgcagcagcactgaccccgtgctcattgacaccatcgacaaagatatagccatttaagtcacggcccgttccaacaaagctatacgggctatcaaaaccgtccgcattggtaacactgtcaaaatggtgattccgtgggattgccactggtcgaccaccaagttcaaaagcaaagtccatggtgcgtgctaaaaactgatcacccgccgtggtttgaatcgttaaactagtacacatgggtttcacatccttgatttaaatactattattctagcatctaaacccattataaacacacatttgcacaaattaatttacgccaatcagtttatcttagtcttttaatcgtaacgtcatcgcattaattgccacgattaccgtactcaacgacatcactaccgcaccaaacatcgggttcaaaatgaaaccgattggtgcgagaatcccagccgctaacggaatcgtgatgacattgtagccagctccccaccacaagttttgagccatcttccgggtcgtccgccgcgccagggccaagaaatcgaccacatcatttggattactcttaacgagaacgatatcggccgaatcaatggcaacgtcagtcccagagccaatggcaacgccaatatctgcccgggccaggctaggggcgtcgttaacgccatcgccaatcatcatgacgtgactaccatcagcctgatactcttgaacgagcttagccttgtcttcaggcaataggcccgcgtgcacttccgtaattccgagctgcttagcaacgacttgggcactctgtggattatcgccagtcagcatcactggggtaatattttgggccttcaaactatcgatcaagtttttggcttccggcttgatctggtcaccttgagcgacaaagcccaagactgtctgctcctgaatcaaaaaactgactgagttaccggcacttgccagtcgattgaacgtttgctggtcataggctaaattttgtttatccaagtaagctgccgaaacgatctgatacgtctgcccatcaatcgtgccgcttaacccgacaccagtaatctgatgaacatcctgactaaccttaggggttaactgatgttccttagcggcagcaagaattccgacagctaagggatgactagagccattttccaaaccggccatcatcgccaagactgcgtccgcagttagccggtcggcgctactttgataatcagcgaccttaaagttaccagctgtcaatgtcccggtcttatccatcaacgcgtagttcaactttttgacttgttccatcgcatcccgattacgaatcagtaacccgtggctggccgcaatcgccgtactccgtgccactaccaatggaattgccaatcctaaagcgtgaggacaagcaatcacgagcactgtcaccgcaattgatagtgctaacgccagattgcccacgagtaaccagacgataaaggcaacgattgcaacggtcaaggcagcgtagaacaagagtccggccactttatccgccatattttcttgcgacgatttggccgcctgtgcgtcactgactaacttcatgacttgggctaagtatccggattcaccagtcccggtgactttcatctcaaacgtcccatcaccattgactgaaccacccacaacttgatccttagcgcgtttttcaactaacttagcttcaccagtaaccatcgcttcattcacactagtcgcaccatttaacactgtgccgtcagctggaatttgttcaccagcccggacctgaacttgatcaccattagctagatcagcaattgccacgtcatggacctgcccatcaactaacttatgtgccgtacttggtaacagttttgctagtttatctaccgccgatcccgcattcatgaccgtattcatctcgatccagtggcctaacaacatgatgacgatcaaagtcgctagttcccagaagaaatcggtcaccattggttttgcatttaacaagtcattggcaaccacagcatagatactgtaaacgtacgccacactgatacccattgtaatcaacgtcatcatggcaggcttatgattcttgacctccgccttggcaccactgaaaaacggttgcccaccgtatagaaacaggatcgtgcccaaaattgcgacgatataatcggaccatggccgaaaaacgatttgaaatggtaaattgacccccatcatcggactcataatgataatcggaatcatcagaactaatgctacccaaaacttcaacttgagattgcccatgtgcatcatttcaccgttacccatatccatatcgcccatgtcatttgaatcatggtgcgccatgtgttgcatatccatgtctttcataatagcgacctcccctagtcagattgtctacatctgtaatttatggctaaagtttacaattgtagacgataaaagtcaagaaaaacactttcttgaagtttcgccatcattcatgggtttgctgagtaccttattttgaaaacaagttcttccgttaaacgtgctgtgacattacggcttgcaagattactcccataatcagttagccaagtatctttaaaatcattagcatcaaaaaagtcatgttcagatttaaaaatccaagcatgacattcagtgttacttcaatattcagttataaccacgttagcaccgcgtccccggcacacaatcgcagtccaccatttctggcgcatccttggccttttcagctagcactgcctgcaaagcagcgatatcggtttgactcaattccgtttggttaacaaggtccaccaacgtttgaccgacgcgcatctggcataaatgaccgaagagggtgcccacggcttcatccatcgatggctgttcctcaaccattggataataattgaacgctcgaccattcttttcagcacgtaacgcaccttttttgacgagccgtcccagcagtgtcttgaccgttgctgtcttccatcccatcttatccgccatgatctcagcgacctgactactcgtgacattgcccaacgtccaagcaacccgcatgacttcccactcggcatcactgatttcgattttagtttgtgcttccaatggtttgaccacccttccgaattaagttaattgtagtttacaaccgtaaacgtgaaaaagcaactatcgtcctcgcacggttcactatccagcatagcgcacttttctttctaatatcaacattgactgctattaaccactaccaaaatcatcactagttaggttaataacttgattggcgcaaaaaaacggccctaattactgagccgcaacaaaatgatctaataatgatgataacgccgcgacgctatctggataattgctcgggtgctgtaataggtaactcttgattttgccgtgatataacaccgtcgtggcggcctgtccgctcgtttgcaataaactgcgccgaaattcattaagcaacagttgtaacccgctttgcgccgcgtcttgccgttccagcatcagtgccgcccggctgatagcatcgagcacctgggtttgcgtgatttgtgattgtgttgacatgtttttccctctatttactataatatgcttaagtatacaccgttagtggcacaaacaggtattatttatctgttgaaaaactatgttatgctactaaatattaattattttagtgacgggggttcaacatttgaaaccaaactcaaaactattacagcgattacgattatggatgcgtgggcggtacggccaaaacgatacgttaaaccgctttttaaacaatctcgctttactactgatcatcatcagttttttcattcgcaccggatggctactcttaattgccgtgatcctcatcggtatcagttactggcgcttattctctaaaaagatttatcagcaagttgcgatcaatcgcggctttcagcgcttttgggcaccgattgtccgcccattcagccgtttaaaataccaggtcaagcaacactggcgataccgctttttccgctgttcacagtgtcatcaacggattcggattccgcgtcatcacggtcgcgttcggataacttgcccacaatgtgggcaccaattcgaagctaaagtgtaaccatgataccggtgtgaaaataaattgattgctaacctgatcttacttagtaatcgcctctgataggcctccttagtttgacactgaggaggcctatttccatgccaaaagcaccgttttaacaacagttgcgtgctatcttcctaattaaatggaccagtcataagtacggtcacggacacactagtgacgtgctggttttcaaattaccgtaaactaattcccttttttcagaaaaaatacttacgaaaaaaataattttctggtatgctaacccattgtattcaggaaagtgagtgtgaacaatataatggattcagtacaaagtagcccgcaagctaaacaacaggcccgcgttcccgttgcccatcccatgctagccatgatggggatgttaattggtggttttgttgggatgtttagtgaaacatcactgaacatcgccctcccccaattgatggctcagctacacgtgtcaacggcaaccgttcagtggttggtaaccggttacatgcttatgattgggattgtccttccactgtcgagcttgattactaagtggtttacgacccgccaagtgattttatttgccttgattgacttcgccgttggtgcaatcatttcagcttcagcgcctggctttggcgtgttattattcggtcgaatggttcaaggtatcgcaactggcctaatcttaccactcatgtttaccgtggccatgcagatttttccaccctacaaattaggggcagctatggggatggtcggtttagtcattatgttcgcaccggccgttggtccaacgattgctggggccatcttaggattggcctcatggcggtggattttttggctctttatcccattcttgattattgcctttctctttgccgtcacttcacttaaaaacattgcaaaagtgacccggccaaaagtggacttcttatccatcctactttcaatggtcggctttggtagcctggttgttggtgttagccttgctagtgatcaaggttggggatcgcccgccgttctaggtgccttaattttgggactggttattctggcttggtatgcccatcgacaactcaccatggactcgccaattctgaaccttaagacattcgccattcctggttttcgggttggcgcttgcctcgttatgatcaactttgggattatcttatcggccatgtacttactcccaatgtacattcaaaagggactgttgattcccgttgccttgactggggtcatcatgttacccggtggtttgatgaatgcgattgtttcagccgtctcaggtcgcttatatgactcgattggtgcccgcacgcccgcaatgctagggttcttgatctcaatggttggtgccctcatgctggcactgacaaccacacagagtgcaacttggtacgttattttggctcacgttatcttaatgattggggcgccattagcgatgtccccttcacaaacgcatggtttaaactccttgacgggtccaattgccgccgatggtagtacaatcatgaacacactacagcaagtcgttggtgccatttcaaccgcaattgcaacgagcttattaggcattggccaagcttcttactacgccaatgggggtcatcaagctgctagcgcgttcgtcaacggtgcccattacgggttctactttacgtttattttagcgctcgccggtttgttgcttgcaacccgtttgtctaaaaaaacgactaactaactgtcattaatcaaaactagcgctgttaatcataagcagcctagtttttttattttacgatcgattatcattgaagtagtcttgggtggcttctcatcagcaagccacccaagactactcagtcaccatgcaatgcttagcgttcttaccacactaagaatcctgataaataattgcactttattgcattttaatgcacaattaaaatgataatatgaggagtcgaaagtaatttatggacttgacaattggtttaattattggcaccagcatcattcttgtcatactgtgtggcatactcagtatttactactatcaccacaccaaaaagctgaacggtacgatctgggcactcattggtattgcgctattgtgcctggctggcttttttgtttgggtcgtctggtttgggttataaactaaactgcggctcaccgttactagtaaccaatccgaggaggaattgctcatgaacccagaagacatgtttcaacgttatctcaacaaatatcagatcacgtatcaacatcctgaacatggtctagttatgctgacctcccctgtctggccccaacatcccgagctccagcaggccattcaaagcgcttttcaaggcctaaacggcgtcactagtattacaatcaatagtcccgaacaattagtcatgcgctatcactctgatcagttacggcggctaagtccgctgactttacttaacttagaacgccagttaagcaagcaatatcatcaagctggctattaaacttaatggaacgcaaaaatgcaggctacccggttaaaagtggatagtctgcatttttgcactttattattgatttagaatgttacagctgccatgattttaccttcatcgccgctaaaatcgacgatgtggcgttttaagttagcagtccaagcttgacacccagccttggcaaactgcttgacagcgtctgctagagccagctggccagcaatatattgcttcgcgatttgttcaactgccgcggcatcttcttcacgagcgacccggactgctaagccattcgtccgccgttccacgagataaccgttctcaccaaagtaagttgtggcaccagtagcaacatcatattgaaaatgttgaacgcccaaatcggcttcttttttggcaatcgtggcaaagtctgcgtggtcacctaaattatttaatacgtcatcgatctcagttaatttaaacatcatgacacccctcgttctaatttcgtttacttaatctattgtaatccaattagacacgtttggcaggtaacgggtagaaaattcgcattaaagccacgtaaatgaccccgataagcgccatgtcaatgaaggttgcaccagtcaccgtcgcaatccaagcaacgtgcttcaataacaagaagatggccacacctagtacccaacataatagcgcaatccagttcaccccatgatgataccaatactgccccttagagctcgccagttcgttgatatcatagtgctggcgatgccgccaatagtaatcgactaacatcacgctgatcatcggtccaagcaccatcccaatataatctaggaacgccgtgaatgcagctaaaaaactccccatgattaatggaatcagtgtgactaacgtggcaatgattgtcacggcccacagtgctggtcgtaaccgaatccgtgggaagatattcgacagcgccgaaccagccgccaataagtttaccgcgttcgccgtcatactcgttaagacaatcaccagtagtgctaatacccccaagcctagtcgactcgcaatggtactcgggtcagagttattaggatcataagttccagaagtaatcgcgatactgatcgtcgcggcaagcccgataaaggcgaaccagaacaagccggtaaaggcccctaaaaatggcatgccagtcgcgccactctttttgcgcgtaaaccgcgtaaaatcagcacccgctgtcacccaagacaaattgaacgccgctagcgtatccatcccagcacccgccgtcatatgtaaatgtgtcggcgcctgccacgttaacaaatcatgcactgagaccgtctggaacacgacgaccgtctcccataaaacaaataagatgacaagaataatacctaaacgttcaatcatctgaaccgaccgttgaccgaccgaaacactcaataagtgcaacacactcatgacgataatcccgaggatcagtcctttagccccaccgggtttaccatagactggccaaccaactaggtcatgcaacaagtaactgacagaagttgctgcaatgaacgtgtttaccgctgtccagccgatatactgggtcaagttcacaaaggacggaacgtaactgccccacacaccaaaggaaccacgaatcaaactcatcgtcgccgcgccagtcttataccccatgaagccgactaacaataaacataaatacgatagcgtggacgatgccacaatcactttaagggccgtcaataacccacacgcagccaatacaccaccaacgtaccacgtgccattattggcattagcgccaatccaagttgcaaacatgtcccaattagacatgtgtcggtgcttaggcgctaccacttctatttgatactttgactcttgctgcacatcgttcaccctttctacaatgttttccattgtagtttttttagtgacgcttggtcaagtctaattaactaagttagttaattgcacaaaacttaaattcgcattaaaataatctcaatatgttaattaaggaagtgacaggttgtgaagggcgcattaacaggctggcgccggaatctcgccgttctctggttaggaacatttatcgccggaatgggtttttctgaagtcatgccattcttatcattatacgttggtcaaatgggggatttctctaagaacgaactcacgatgtatagcgggattacatacgcagtaacttttttcgtcgtcgccgttgtctcaccattatggggtaaactcgctgaccggcgtggtcgcaaaatcatgctgctgcgctcttcgcttgggatggcctttgttatcggtgcaatgggatttgtccataacatttggatactcattctacttcggttcttacaaggcctgtgtgccggctacattcccaatgctagcgccctgattgctaccgaaactcccaaggaaagtagtgggaccgcaatcggtatcctaacgaccggttacgtgtccggtaacttaatcggcccgattctcggtggtgtgctcgcccagatcttttcgattcgtttgactttcatcatcaccggaatcttgctactgatcgtcttcgtattgagtctgacactcgtccacgaaagcttcaaacccagcgacgcgccgattgctaaacgtgatggcagtctactcagccaattcaaaaatccaaccttgattatcaccctgctcgtctccacgatgattattcaaatggggaacaattccatcacgcccattattagtctgtacgtcaaagaactgatgcataatgtcggtccaatcaccgtcgttgcgggaatcattgccgcattgcccggcatctcgacactactatcggcgccgcgactcggccggctcggtgatcaccggggagctgaccgtatcctcgtctttggcttcgtcttcgccattttgatgtacttcccacaaggcttcgtctccagtgtgtggacattagggctattgcgcttcatgattggaatttctgacggggccctctttccaacggtgcaaacattattatccaaaaatacaccccgcgagttaacaggcactattttcagttggaatcaatctttccaagcggctggcagcatgctcggttccctacttgggggcgccgtctccggctggttcgattacaacggtgtctttatcttcaccgccttgtcattactactcaacttcatcggcgtactgatctttatcccaagcatgcgacacccatttgcaaaacactcggttgattaatcgcgctatttatcacgttcaaaagctatcagcttagtcccggcggtcgaactagaccgcgaccggctgacaaacactaatccgactagcgtatcttaaccataatcaaggccaccaatcagctattgttgattggtggccttgattagttatgcaattgcgttggcgcttacttcaaatatttcgccatgaactggctgactttttgttgatataattgcggataacgcgtgtatgattctgcgtgcccagctcctggaaccacccatagttgcttggatttcaccgtcgtagcgtgatagttctgatataccatcttcgtagggacaaaagtatccttagcaccatgaataaagaagattggcaatttattcttcttgagctggtttactgaactagccgtcatgaagttaaaatgggccttcgcctgagccacccagctcgccgtatacagcaacggaaacttcggtaagtgatacagttgattcaactcataccctaattcatcaccaacactggtgtaaccacaatcttcaataatcgctttaacttgtgatgggagtttctcaccgctcatcatcatgacggtcgcaccgcccattgaaaccccaaagagtccaatctgactattttgaccgacgcgacgaatcacctgtcgcgtccactttagatagtccaaccggtcaggccaaccaaaaccgtagtagtccccctgactctgaccattgccccgatcatctggcgccagcacgttatatccttggcgatgccacaatcgaatatagctcgccatctgctccttgttgcccatgtaaccgtgcgccacaataatcgttttggtggtccggtgcgcagctggtacgtagtccgcaactaacttcaaatgatccgttgcggacgtctcatgccaggtctgcttgttgacccgtttcagccacgcttggttctgcttcaacttacttttactcttactagaactgtggttcaaaactttcggggtgggttcaaatgcaaagtgatataaataaaaactaccgcccgcgaccccgatgacgattacggtcaaaaatgcaatgagcgcaatcgtccattttttgcgtgttgtcatattctctttctctctttcatacctaagctcttctcctaaacctaattcgcttcagttcaaatacgctacaaatatccatagcgatactagcaaacgctattctcaaacatgcgattatcgcaactcaatccgtcaattcattaagcgtccgaatcgttaataagtgtgccgccaccgtttgcgccgctaattgaattgcccgtgccaacgggtcaaccgtcgataagacaaccggttgtccagcaagcccagactcaaatgcttgccgaaactgttggtatcgtggctcaatctgacgcgaatcacgaatctgcaaaatcgctttactaattactggcaatgaaaaatcagtcttcaaaattgaaacgaccaacaccgccacaatctgatttcgggtataccgatgtccaaccggccgactgaaaaaatgttgtttcacgtaactattaatcatcgtcttcgttacggcaggcaaccccagcggctgaatcgtttcattaacaagttgcaacaactgttccatataaacgggcaccgcaggcaattcttcccacgaaagtaaataattgctagttaatccaaattccgccatcatccaatcctcctcactaccctatttaatttagcccaatttagattttaattcaacaatatctaatcatcaccctattataaatagaattataatctatatatctgttctgctaattattagtcgcatcaaaaattattaaacggtgcttgttttgtaatctcaaaagcagccagcttaggcccgctggaaacagttcgggttagcgtaaatctgcttagtttgttcgtcctacaccgacctccaggcatttctgccaattgccggaacgtggtgggcacagatttaagccgaagcccacgtcttaaatactggcctttcactaaccaagcacaagacgcttgctaagtgaaatttcaccactgggcattgtcagaaatgccttccagtcgggatggtattcgaatggctgacgaagatgtacccaacttttgatgagtttgtcattgttcttcataaacagtaattttgttaatcaactgttaggtcgcaaagatattggggtagctcgctaattcggaattactatagtaataatagaacgcctcaacaaagtggttagggtaaccctaatgtctcgctcaaagttcccgtatcaaagtagccaacgaccaattgcaccaagttaagcggccgttcatctgccattcgagcggcttaccgaccggaggggctgggtgacaatgctcagtagccaaattattcttagtcggaagtgattttcttccggcttagaataagactcgtatttgagatgacgcgggttgtgcgttagctcaaatcgacgtcggcttacgttccagcaattgtcacccagccccggaggtcggaatagaacgcgcatcggcggacgaacagcaatcccaaaataagcaccgtttaataatgatttacgccaaatcaaggcttgaaagccaccccatgtttccgctaaaataggcttatcaaaattttgttatccagaaaggaaatcattatgaataacgtttacctagctgcaccgttttttgacgaggctcagaaggaacgcatccaacaagtgaagtcggcgctattggctaacccgacgatcaatccggatggaatcttcattccagaagaacatcaatttgaagaagaaccttttggtagtcgggcttggcaacaatacgtctacgcatctgatatgcgtcaagttcatcgggccgatgtcgttgtcgccattcttgacttcgacatgactagtgcaaccaatgaaccagattctggcacgatgtttgaaatcggtgcggccgtggctgaaaagacacccgtcatcgtcgttcagtttgatgcaaataaagaactcaacttaatgattgcccaaggattgacggcctatttcgatgctagtaaagatggtctgaaagaattatctgcctacaattgtgatgacttacgttctaagcccgctcaccggccagtattttaagcacacaacttaatgacacgaaaaaatgctgcttgcaaacgaataatgtttgtaagcagcattttaactaacttgaattgattattcttattcagcggtattcacgactaagcgtgactgtcgccgtgcctgccagcgcttgttgagttccagtacgactgttggaatcagcgtggctactagcaccgttaaccagcctaacgcgggtagtgtcactaagctgaagaaactacggaacggtgggatcactgcaattgccaagaccactagaattcctaacagcaatcctcggttcagcatcggattacgcgtcatgcttgaccagctgagtggtcggcgatccttgattgcatagatgtcgatcattgatcctaatgctaatactagaaagaccatcgtcatcccgactggggcttgaccatttgttaagccaaagcggccaaatgcgtaaattccgagggttagtacggtaaaggtcgctgcccggataaacaaccgttgaccaaggccccgagctaagatactttcgtcattggctactggtggttgttgcatggcttggggttcacctggctcttggctaataaagaatcctgggatcccatcagcaagtacgttaataatcagcaattgttctgctaacagtggcgccccccaaccgaagaggacggcacctaccatcaagaagatttgtgcaaagttgacacctaccaagaattcaacggctttaatgatattctgataaactgtccggccttccttaactgctgccatgatcgtcgcaaaattatcatccgttaacaccatgtcagcggcttccttagatacttcggtacccgtaattcccattgcaatcccaacatccgccgccttcaatgccggcgcatcattgacaccatcaccggtcatcgcaaccgtcttaccaagactttgccaagcctgaacgattctgatcttgtcactcggcgaaacccgggcgtatactgcaatctgttcaatctgagccgtcaattcttcatcgctcaattggcgtaactcatcaccgctaattgcttgcagctcaggggtcaaaatgccaatttcctcagcgatagccttcgcagtaaccaaatgatctcccgtgatcataactggaaaaatacccgcctgtttggctgctcgaatggccggaatcacttctggtcgtggtggatcaatcaaaccaatcaatcctgccaattggaggtcagctgtcaggtcgtcccagtcagtagtttggacatccgcgggaatgatgcgatagccaacagctaacacgcgcagcgccgcttgtccaaattcatcgtgggccacttgtccagcggctaggctcgcttggtcaggcttcagtggtaaccgatcccatgcccctttgacgataactaaccgttgaccatctgctaatttatgcaccgtcgtcatcatcttcttagtcgaatcaaacgggtcttccgcaattcgcggggccgcttcttccaagctgggccggtctaaatcatgctgagccagccaccgtataacggctagttcggtggcgtccccaatggcttgttcttcaccgtcgacgtggttgatctcggcattcgtcgccaggcccaagtaacgcatcaatgtttgtcccgctgatggcaagggctgttcggtcgtcataatgcccgtggtcggcgtccaatacttcgtaattgtcattcgattttgcgtcaaggttccggtcttgtcagacgcgattacgtcgacactcccaatcgtttcaacggcactaactcggcgcatgatagcatttctgtctgccatccgtcgaacaccgtgtgaaagactgatggtcacgatgatcggcagagtctctggcacggccgcgaccgctaatgaaaccccaatcatcaagctatcggccaaaccttggttttgcacccaaacactcagcgcaaaaatcgtaataccacctaagacggcaaatgtcgttaaccagcttgatagccgattaagccgcccctgtaatggcgtggcccgttgcttcgtcttgttcaacaaacctgcaatttgacctaactctgtggccattccggtcgttaagacctgaatcaatgcagtaccggctgtgacggccgttcccgcatacacttgacagttatcatccaactcaccggtgtcctgataaatacttttttcaacagcttcactttcacctgtcaagactgcctcatcaacggctaagttcgtggcctctaacacgaccgcatcggctggaacctggtcacccgcttttagtagcactaaatcaccgggaacgatttctggtgccgcaatcgtttgtaccttcccatcccgtcgaacattagctgtgggtaaactcattgacttcagtgccgccaacgacttttctgcggaagcttcttggtacaaaccaatacagacattaataactaaaatggcgccaatcacaatggtctttgtccagcccccattctgggcaagagccaagtacgtggctaaaccaactgcaaataataacactagcgatgaaacgtcgctcatatgttgccaaattttacgccataacggtacggggcgcgcagctactaattcatttttaccgaatttagttagctgggtcgtcaccgctgtggtcgttaaaccggactcgggggtaggtttgaatggtgcattctgataattctgcatcgtttattcctccgtaattcgattatcgttgtcattcgtcactattaatgatagcggaaacattttgtcgttttacgtgcaaattgtgaaaaagtcgtgaagattagaacgcacaattgaagcagccattaaacattaaccacaggtcatcatcaaaaaactgttcaatttatgactaaaatcaagttaccagccatgaatattgttataatagaacacaaatattccttggaggcacgttatgaaaatcaaattaatctcaactagtgatgtgcacggttacctcgcgccaactgactacagtcgtcgtgataacatcgcaccatttagtcttagtcgtgccgctactgttattcatcaactgtcacgtgaagatacggctgatgtctggccaatcgtgattgataatggcgactacgtacagggatcaccgttgacctatttcattgctcgccaccaccaagaagctgcaccgttatactcgcgccttgcaaattgcaaccacgttcaagccggtattttcggtaaccatgaattcaactacgggctcgactacctcgacctgtgtgaatcaagccgccaatatccgatgctggccgctaatattcatgatgacctgcaccgcaccttattctccaaaccatatacgattctggaacgcgccggagttaaagtggcaattttgggactaacgacgcaattcgttgcccactgggaacaaccacatcacattgctggcctgcactttgaggacgtggttgcaactgctaaacactgggtacccaaattgcgccaactggctgacgtcgttgtcgtcgcctaccacggtggtcttgaacgcgatccccaaactgaccgtccaaccgaacgcatgaatggtgaaaaccggggttccgcactattagctgaagtacccggcattgatgccatgattactggccaccaacaccggagattagccgttacggttcacggtgttcccgtgacgcaacctggtatgaaaggtactaatgttgctatgattacccttgaactcgaccacaatcatcaagtgacgaccagtcttccggaaatctatccagtcgcagatgccaccccgaacgcccaggtaatgcaattagttgggtcaatcaatgaccagatggaagactggctagacaccccgctcggtcaaattaatggcaatatgctcgtacatgatcatcttcaagcacggctgcataatcatccttacatcgattttattaatcgcgttgaaatggccgcaaccggtaccgatattgccgccacggcattatttaatgacgacgtaccaggcctcaaacaacacgtgacaatgcgggaagtcatgaacagttacgtctacccaaacaaacttgccgttgaagccattactggtgctgatttacgcgccgctcttgaacgttgtgcgagttactttctcctccaagacggtcacgttcgggtcaatcccgagttcatgcaccctaagttgcgccactatgtctatgatatttacagtggcatcgactatactttcgaccttaccaaaccttttggtcaacgtgtcgttcaactcgattatcacggggccccggtcaccgctgaccaaaaattaacggtcactctgaatcattaccgcgctggtggcggcggtaattacccgatgtatcaagcggcaaaaatcattcggcgcttacctactgatatgaccgtattaattgccgactactttgcgcaacaccccgtcgtcaacgctacccagccgactaattttcaagttcactattaaagaattacacgacaaaatccgcccaaacattaaccatttgagcggatttttgcatacttgcgtttataatatctagttacatgatcatatcgtaaccagcctcgttgaaccatgcctgttaaccctgtcaattaggctcataacagcactgactagaagctgtatcctccttacaagcgtctcacaaaccccatatggcaatcagactatccccgtcacaccagctgcaacccccacattaagaatcccatggtcagcggcgcaatgaccgtacttaacatttgcgtcgccacatactcatctggtgccaagtggttttggacggccaacatagttgcgatggtggcagtcgggattgcgagtgtcaagacaactaactgttggttacctaatgacacacccagactggccatgattccccaaacgagcaccggcaagcctaaatttttcagtagcacgtttaagacaaccatgcgcgtcagtcgccacggtctggccgttaacagcagccccagcgcaaataacgccacgcccccagctgcttgtcccaactccgtaaaattcgttagccaagcactgggcaaccgcaatccggctagatttaagagaaaggcactgattggcgcccacacgactggttgccgacttgcactgcacactttctgccaaccagctcgccaacgttgctcaggagccgccccacccgccagcgttaacagtaacacgctcagcggcacttgtaccaagttcatatacaggccgcccaacgcgaccaataaaacactgattttaccaaaaactacgagtaagacggaaacacccatgaacggaattgaaggactggcaatcactagcgctcgtaacgtccccgtttctagttgctggtggaaacagcactgacatacaatgacgatgaccatgccacccagcatgcctagcgccagccacagtgcgaccgaggagttttgaataatggtagcgcgctttaatgacaagattcctccgaaaagacttaacggcaaggcgtaatgcatgaccaactgaatcaaaatatcactggtcgttggcgtaaattgatgccgtcgccccgcaaacacgcctaatcccaccgtcacaacaattggtaaaattgctaatatcagtaacattcacaggcccccagacttaataattaaaactgagtgtaccatagtccaatcgccgtgatagtcaggttgctagtcaacaatcggacatcttatgacgtttcattagtctaattaggggccgacctcatattattaagcggccgcgccacgctttttacgataacaacgaattttctaatttaactagctgactttgacaattaggtgattggtcaaataaaaaggatgctgccagtggctgcatccttaataacgatgaaatttagaaattaacttgatcaggatcattagctaacccggcaacaccgtggaaaccatcaatgaccttcatatcatcatcgctgagttcgaaatcaaataattccgtattttgttcaatccgatccgcatgaactgattttggtaatggtaagaaaccgtgttgtaatgaccaacgtagcacaacttgggcaacgctcttatcatacttatcagccaacgtctttaattctgggatactgaagatcttaccagtacctaatggactataagcttctgataaaatgtcatgtttgcggttgtaggccacaacttcatcttccatatcactaggattgaggaagatttggttaacggctggcacaaccttggctgtcttaagcagcgcgtctaaatgcttaggacggaagttagaaaccccgatagcccgtgctttacgtgccgtgtaagcttcttccattgcccgccaagtatcggcgttcaattgttcccaattgtcgcgcattgcggctgggtttggccagtggatcaagtagaggtcaacatagtccaaacctaacttagccaacgaggtatccagcgccttcttggcagcgtcatagccatggtcggcattccataatttggtcgtgacgaataggtcttcacgggccacaccactatcggcaatagctttaccaacactttcctcgttaccataggccgccgccgtgtcaatgtgacggtaaccggcctttaatgcggctaatacggaatcgtaagcaacctgaccatcaggtgtttgccacgttccaaaaccaacaatcggaatcttagtgccgttatttaacgtgtacgtatcggtgagtttagtcaatgcagtcatcgaaaatgcctccaaaaatttatttgttaagataattctacccataaccgaccacttccggcaaacattctgttccaaactaatgacgatacgcaaaattcgtgagaaaatataaacattctgatgtgggaggggttttgatgagcgatacggcagttatgttaaaaaccacgttattggccggcgccattttgctagaaaatggggctgaaatcaaacgagttgaagacacgatgcaacgaattgcaaccaacgcgggctaccctgacgcgcaggtcttcgtactgttaacagggattaccgtctccttgccggaaaatgccactagcgaagtgcgagcaatccataatcggggtatggacctcgaaaaagtggatcaggtcaacagcctgtcacggcagtttgctaatcacgatatcgatttaactgaatttgccgcagccctcgaacgggtcaatcaagccgtaccgaccttcccattcagctggttatgtctagcggccgttgtcgttagtgtgccgttgatggtcgcctttaccgggcggacaacccctgccgacttgattacttgtggactagctgggttggctggttttgctgccttttattggatcaatcggctgggatcaattcggtttctcagcgaatttatgggcgcttttattattggtctaattaccctactcggcttttatctcactaacggtcattatcatcccgacgccatcattattggcgctgtgatgccattagtgccaggtgtcgccattactaatgctgtccgtgacacaatgacgggtaacttactgagtggtcctgcccgcgctgtagaggccgttttatccgcgtgtgcgattggtgttggtatcgcactgacttcatttttctactaaaggaggcgtgacatgctacattggctcttaacaaccggtttatttcaaattatcttagcttacttagctacggctggttttggggtacttctcaatattccgcgtcgcgccgttaacctcagtggttgggtcggtgctgctggctggtttacgtatgaggtcctctatcacatcctgccattaggaatcgacgccaaacttgcgattggtaacctcgtcgcagctatcgtgattggcgtcgctagcggtatggccgcacgctacaaacgaatgccgatgatcatctttaatatccctagtctggtcccactggttcctggtggccagtcttatcgagtcgttcgtaacttggtcactggtcaaccagacttggcctaccagtactttgtacaagttgtcattattgctggcgtgattgcaattggctttctcgtcgctgaatttatcaatcgcattactttacactttgtttaatcaggaagatcagctagtgcatctttgtcggttagcaaaatgacaccacgttatcttgatttgcagctgctagacttcttaatgattagcaaaaaaatagataacgccttttactaagtacttacaataaaagtaagttaataggtctaatatagttcaaattgtgggcttataagcctgcaacatttacaataataattgtatttaacctgcgattttctaatttggagggagaaaagctccatttattatttagatactgacaaataagcttagaggaaaagaaaatacccttggtacgattggtataaaattatgaccttcattaatatttttcaaaactgtaaattcaattaaaatactgcctaattacgattctacagctgcaatttcaatgtgattgcgaagccttaaaaggtagtatacgaggagaatattacaatgaatactaagtctaatcatctcatcgaatggctgctcaccttattattaatagtctcaattctgataaatgttggttggtttatttttcgatatggcggtcattactactacatgaaaatatcgagtagtaccggaacttccccaattacactaccggtcaatgtcccagctactgggtatcaataccaaggactagcaactaattctaagggcgaaaaaagtatcttcattttaatacagttgttgctgatccagccccattcaaacgcggacaaattgtcagaatcacattcaatcaaaggtacggcgtaaccaactataaattagttcatcggtaacacgattacttcaaaaaagccgtcataacgattggtctatcacttatccaatcgttatgacggtccatccattactagaatgatataatctaaaaagtcagcaactaatttatagtcgctgactttatttattcatgatatttgcggcaacaagcttagccaaaagtgacgcttctagtatttaatgaatcaacgtaaagtagccaatcacaagtacccccaggacaattcggtaccaaccgaacgccttgaagtcgtttttcttgatgtaatccaacaagaaacgaatcgacaagtaagcgactacgaaggacacgatcaccccaacggctaagactgctccttgcaaaccagctaaagaaccaccgtgagcaaagaatttcacaagcttcaataatgacgccccaaacattgttggaattgccatgaagaatgaaaactcagttgcgacgtagcgtgaagttccaatcaagatagcccccaaaatggttgcaccggaacgtgaagtccctggaatcaatgaaagcaactggaaacacccaatgaacagtgccgtcgtataaggtaacgtttgtagattagcgaagcggggtgttaagcgcttattatgattttcaatcacaatgaataggaccccataaataatcaacgtggcagaaacgaccgcccaattcattaaatgttcgtccatccaatcatttaacggtagtcccacaatcactgatggaatgaccgctaataacaccttactccagagaacccaagtatttcgcttttccgtggtatccttgcgtggtgacaacggatttagtttatggaaatacaggacaacgaccgccatgatcgcccctaattgaatcacgacgttgaacatatccgtaaactgcgtggactgttgcatcttgataaattcgtcaactaggactaaatgccccgttgaactaattggtaagaattcagtaatcccttcaacgatccccaagattaccgctttaaaaatatctaacacaatggattcctttcttgttggcaacgattatcgcttgataatcccaatacataaagatttacgaccatccccgatggccgccatatcaacattatagcaagcagttatccaagatagtagcgtccatgtgtatttttttggtaaagattaatttgtcagcgctaccaacgccgtactaaatgcattttgtgtttggtcatcaaaacaaacaatcgtgattgtctgaaccgtgtgggccgttgtctgcgcggttgcttgtaacgtttttaacgctaacggcgctgcaatcgatagcggaaagtgatagacgccggtactgattgacggaaaagcaaccgtttgacaatgattctcagcggccaaattcagactgttgcgataactattcgctaacaattgtaattcgttatgttgcccaccttgccaaacggggcctggcgtgtgaatgacatacttcgccggtagtcgaaagcccggcgtaatcttggcttcgccagttgcacaaccgtgtaatgggcgacaggccgccagtaactccggtcccgctgcccgatgaatggcaccatcgacgccgccaccaccaagcaaactcgtattggccgcattaacaattgcatcaacggtcattttggtaatatcaccgtgaatgactttaatctcaaccatcttaaactgcccccataatcagattaacgctcgtttgagcctgttgttttagctgtgccccactaggatcctgttttgccaatagctgaatgccgctgcgaacctgcattaaacttgctgcagcctcagcgaccgtggtcggtaaggttttagcctgcggtgaaagtaaaccgacgagtcgggtctgtaaatcagcatagatcgtttgcaattgggccatcaaggacgcatcctgcgacccaatctcggccatcaggttcaccatcaaacatcctgcgggccaccgttcactctgaaacggtagtcgcaaacaagccgcaattaaagcgggcaatggcgtttgccgcgcccgctcgcgttgaatcaactgatccaattgttcgtccaacgtactttggtagcgctcaaggcatcgtcgtaatgcgacgcgcttgttatgatactgacgatagaattgggtgtgtgataaccggctaacagtaagcaaatcgtcaaccgtcgtttgataataaccaccttgccaaaactgaatcatcattgccgtttcaactgcagatacatccttaacagccatgctaaaacctcctgaaactgacgtgccatcttaatcagctactaaatattgaataccgcgaataatcgaccatagatagcttgctaccgcaaccagaccaaatacggctagtaataccaccgccaaccagccactattcgctaaattattcatatagatgccgctcacacctaaaatgacgagcaacgtaattcctaagattgtcggcagtaaatggagccaaaaggcccgtcccgctactcgatgagcctctggattagtactcgttaatagccaaacaattagtgggaataaaactggtaagaataaaatgcttaaataactcaatgcgttaatcactcgattttgtgtcatcgtcctaacctcccccggtatttattccgagtatagcgaaagtctggtacttcggcaaataataaacaaattgttaaaatacttaggactctcccaaggttacgccccgaatgttaacttacaatcacggtctgctataataatgacataacctaaccttgcaatcgttagttgccactgtacaacccgggagcgaacggttcacgttgggatttagatgcattagttaagatgcggaggaaaagaaaatgacgaaacgaatgagtttcaaatttaaatgggtcgccctcgttgccaccctgatcgttgggcttggcggctggcaagcccttgcgcacgctgacagtagtagcgacgaaccaattgtcacattaggcagtagcctgactagtagtcaaaagaccgggacaatcaacacattgacggccagtttgaacggtgccgattatcaaacactgaccgttaacggcgataccctagtcaaatacctcaatccggctggtgaaagttttacaagtacctcgggtgtgtggtccagcgcgatgattcaaaagacaagttctggttccggaattaatgttaaaattctagattataacggcagtaataatatcaccaccattacggctaaccaatataaaaatgcggcactgacagccggaattaccgatgccaatatttacgtgacgtcggctaccccaatcgacggttcaggcgcgctagctggtgtgtacgcggcgtacgctaaatctggtaatagcttgaatacgaagcaagtgaccgctgcccaggacgaattgagtacactcagcggcatcacccaagcgaataagagcaaggacggctataccgattcccagttaaataatgccgtggccggtgctaaaaaggaaatggctcaaaaggggagcagtattaccaagaacgaaatcacgaccatcgtgaaccaacagattaccaataacaatttaacgaacgtcattaccaataatcaaaaaactgaaattattaatttacttgttaagatccgtgactctggtgcgttagactcttcaagcttcaagacccaggctaactcactgatgaagaacattcagtccaatgcgaagggcgtcttcagtaagctcaacaccaaggaaaaccagaacttacttcaaaagatgtggagcgccatcgtgaacttcttcagttctatctttaaatcaatctttggctaagtattaatgacttaatgaatgccgctaacatgaaggcacagcatgaatagccgttgtaggaatctttagctcctgcaacggctttttgatggcaaatttttctattgcaacaacgataagcagtcactagtatcctgctcaactggccgtgacccatctttagttcagccaataacaaccaacaaacagtccagtgacttaagccaccctgagcacacccccgctgataatatgaccaaaatagcagttatccagttaacccatcgttcgtggtgattatacaacaatgtaagcgacgtcatctttgcacttatatactgagtgtgtaagttttccagtacaaactagtattaagttgggttatgaattattaaaaatcaattaatcggttacagtccttccccttcacacgcttcatctttatccgctcagaccccataaacactagcaaaaaagttgcttcaagaatgttattcacattcttgaagcaacttttttagcatcaatcatcaaatatcaacccgactctcagcgccgagtaagatgcaccaactatgtgcaccgggtgattggcttcaaactacttaagcttcggcccgtttcaaatccgtatcagcataggtcgtcttcttggtttgcttgctagcattttcgttaacaaacttatccatgaattcttctactaagttcagcgtctgatactgttttgctaaactaaaactttgacgccattcccggttgcgttgaaccaattcagtaaagacttcatgttcgatccgagcgccttctggtgttaacttcaacactttgttacgacgatcatgatcttcagcttcctgatataagtaatctttccgtaataagcgaccaatcaagcgtgagattgcagagcgcgtcacaccgtggctttcagcgatatccatcaaacggattttgccctttgcttcagcgatatcatatagaatataaaactcatctaaagtaattccatgttccgttgcaggttcagcaaacatatctgataagttcttgaaaccatgcaaatacatgtggctaaagcgattaaaaaattccatatcttcattcattgttccagtctccctttcactagtcgaattatcattaaattcccaatcataattcgccccatacttttataaataaattagtaagcgtcgtttatcatttccccgctttaaagtgtactagtatattttacgaaatacaagtaatttagattactttaatattaaatttttatttcagtactcaagtcgagggttgcgtgcttatgcagataggtgatgaattcctgataataataatccgtattatatttagccgtactcagataaatttggtcaattttctcagtattctcgcctaataacaagtaaaacgcttggtcgatattctctgcaatcatacccacactagctcttaaaattttacgcttgaagaatacggccatgccaccagataacgcgaagttcagcgcgtatctaatcatggcagcctcgccttctacaccaatcgcttctagccagtctagtgtcacaagcaccatttcggtcgtcaattccggactctcaaaaatgtctttaatgaagtgttccatggttggattctcatctaacattcgcaagacaaagctcatctgaatcatcgtccgctggtatgaggacagcatggtcagctgttcattgctatagataaaggcactcagcgtcaattcattcagcatcgtacttaataaaacgatcttcttcgggaagtagtgttgtaacaacgacttgctgatatcacaggcaacggcgatgtccttcatctgaacattcgcataaccctgttcggcaaataagcgaaacgccgtattaacaatctccattcgccgttgcgtgttccttcttcgtggcaagaaagatgccccctatcactgattttaaatcattctcttttaataaactatactaatatagctttgaacgcaagtgataatttaatcggaaagttaatcaataacacccttaactatattaatgatcactatttatcaataaaatccccaagcgccatgagcgacaagttgccccaaaattaggacaattacagtctttagtggctaaaaacaggactgaccgttcattagcgaaaaagaaaacgctttcttatacaaaagtttgtgctaaaattaacttattaacttgcagggaggctacaacatgagcactaaaaattcttatcaattagctgatattggtcgtcataatccaatcttttcacagatccgttccaccgtcgaaacggccttttacggtaacaatatgcaccacgttgataatgtcgctgacgcataccaccgcgctaccaaggaccccggaaccgttattacggacctcccaatctatcgcgcaacagacttaggcttaccagctgatgccaaaatgttgattgccaatacgggtaaggtcgttggccggaccgcacaagcacgccggattctaggcaatcccggcgttagcgaggcggacatggctggtcgcttacgccaggcactattcgctagcgcgcacaaggacttcatcaagacggacgtgctggttggactagatgaagacttcatcgtgcgggcccacctcgcgattccagatgggtttgccaataatctgctctcttacatgcttaacttccagcccatcaccgcggcttatcaaaaaatgttcgatcagtccgttgcttatccagaaggcgacatttacatttacgccgaccctacttatcatgatcccgattatccagacggcctggctatttttgatccgcaacataatacggccgccattctggggatgccttactttggtgagctaaagaaatcgactttgaccttagcttggtcgattgctcatcgccacggcttcgttgcttgtcacggtggcttgaaggccttccacttcaaggacaagcaagaccaagtcttcgccatgttcgggttatcaggttccggtaagtcaacactaacccacgctaaacacggctataaatacgatatcaccgttctccacgacgacgcctttgtcatcaatcgcaaggatggtagttccgtggccctcgagccttcttactttgacaaaaccaacgactatccgatgacgtccgatgagaccaagtattttatgacgatccaaaacgtcggcgtcaccttagacgatcagggtcgcaaggtccttgtcactgaagatctgcgcaacggtaacggccggacgatcaagtcacggtacgcttcgactaaccgggttgataaggaagccgctcccatcaatgcaatcttctggattatgaaagatgatagcttaccacccgtgattaaagtagatgatcccgtattagcagcgacattcggcgccactttagcgaccaaacggagctcggccgaaaatattattggtaatgtcgaccgtaacgccctagtgatcgaaccatttgcaaacccatttagggtctatccactatcagaagattaccatgatttcaaggcactcttcgaagaacgccatttagattgttatctattgaatactggcttctttggcgataagaagattcctaaggaagttaccttgggtgcgctggaagccattgtcaatgatacgaccgagtgggagtcattcgcaggcttggagcacatgcaaaacctaaagttagctgatttcccagttgattatgccaatgcagactaccgtaacttggtcgccactcgtttaggaattcgggctaacttcattgatcaatatcaacacaacaatcatgaccagcttccccatgagattattgatattctggtccacctacaagatcaattaaaacaaccaattacaaaataggatggcattcgttccccgcttcagaccaattaaggttataataaaagtagcaggtatatggcactgaacttttacgaattctaaaaatcggggtgaggagcatggaactaccattaagtcaattatcagaaaagctcatcagttttgaacgcgagcaccatcttacagataacgaccttgcgtttggcagtcaattatcagttgaacggattcacaacattaaatctggtgaagcaacgccaactcaggaagaattgcaactgttgaagaaattcatgaatagcaaagccaaagcttaactgctagttcagcgataaagcctaattggggcaaagatcctcactaaaaactggtcgtccattcgaccagtttttttgttacctaccatccagattgcattttaatttaccctgttatcacctcgtgctatactcggcacaacttataaagataagggtgaccaacatggcaatgttatacggtaaacacaatcatgaagctgaagaatacttggaaccagtctttggtgcgccttctgaacaacatgatcttcctaagtatcggttaccaaagcattcattatcccctcgagaagccgatcgcttagttcgtgatgaattattagatgaaggcaattcacgactgaacctggcaactttttgtcagacctatatggaacccgaagccgttgaattgatgaaggatacgctggctaagaatgccatcgacaaatctgagtacccccgcacggccgagattgaaaatcggtgtgtgaacattattgccaatctgtggcacgcacctgatgacgaacactttacgggtacctctacgattggctcctctgaagcttgtatgttaggcggtttagcaatgaaattcgcctggcgtaaacgcgctcaagcggcaggtttagatctgaatgcccatcgacctaacctcgttatttcggctggctatcaagtttgctgggaaaagttttgtgtctactgggacgttgacatgcacgtggtcccaatggatgagcaacacatggcccttgacgttaaccacgtcttagactacgtggacgaatacacaattggtatcgtcggtatcatgggcatcacttataccggtcaatatgacgacctagccgcactcgataaggtcgttactcactacaatcatcagcatcccaaattaccagtctacattcacgttgacgcagcgtcaggtggcttctataccccatttattgagccgcaactcatctgggacttccggttggctaacgtcgtttcgatcaacgcctccgggcacaagtacggtttagtttatcccggggtcggctgggtcgtttggcgtgatcgtcagtttttaccgccagaattagtcttcaaagttagttatttaggtggggagttgccgacaatggcaatcaacttctcacatagtgcggctcagctcattggacaatactataatttcattcgctttggtatggacggttaccgcgagattcaaacaaagactcacgatgttgcccgctacctggcagccgctctggataaagttggtgagtttaagatgatcaataacggacaccaactccccctgatttgttaccaactagccccgcgcgaagatcgtgaatggaccctttatgatttatcggatcgcctattaatgaacggttggcaagtaccaacgtatcctttacctgctaatctggaacaacaagtcatccaacgaatcgtcgttcgggctgactttggcatgaatatggcccacgatttcatggatgacctgaccaaggctgtccatgacttaaaccaagcccacattgtctatcatcatgacgcggcacctaagaaatacggattcacacactgaatcatcacgttattttgataaaatagttaaacttcagaaaataattattatcactcgtgtatacaaaaaatagcatcatccagattctgacgaaccgggatgatgctatttatccatttaaaggatattaattacatgtggatagcaaagcttggtgtgtagtaagctgtgctcttaattgaaacagtttcaccataagttggtgaagcgatgtattggccaccgcctaagtaaatcccaacgtggtaaggtgctgaatcagaaccccagaaaatcaagtcgccagcttgtgcttggctgaatgatacgtgagtaccaatcgttgcttgggcataagtagtccgaccaattgaacgaccaaccttagcaaaggcagcttgcgtgaatgcagagcaatccatttgttcgtaaggtgtgccaatgaaagtcttgccagcagcaattactgaactgtatgatgcagttgaactagttgttgctgaagcacggtaggctgttgcagtagcagtcgttgttgatgaactgttcgttgttgtgttacttgcagttgagctagcttgtgaactcgttgaagtagcagctgattgcgtgctagtagacgatgctactgaagttgagctttgtgatgcttgtgaagctgaactttggctagcagagctttgtgaagttgctgaactagttacagcacttgaactagcttgtgaaactactgaactcgttgaagcacttgaagttacactgcttgcactagcagttgaagtactactcgattgcgcagctactgagctacttgatactgcttggctcgtactacttgcactagtagttgatgagctggttgcagcagcactagtagttgaactagcagcttgtgaactcgttgaagttgcagcactagtcgacttggcactgcttgcactagcagcggtcttcttagccgtaaccttttcaccggtcttaacaccaggaatattgatggtcttaccagcaataatcatattaggattgcttaaaccattagcttcagcaatcttgtcaacagaaacatggtacttttgtgcgtatgcccaaacagtgtcccctgctttgattgtcattgaatcggcattggcaactgcttgactagtaactaacataccagctaaagcagcagttcctaacatcacttgtttaatatttactttcactttaataatgatcactccaaaaagaatgtcacgtatgtacttcaagccaacgtctatactactcaatttgtgttacataccaataccagcaaaataacaatatgttacgaaagttacaaaaccgtaacaataattagccatcgtaacatttccgcgctgaaaccctatcataccggcatcgttttattactaaaatttgagaccatttagcaactttgacgaaaaaaagttatttttattttaaaaagccgaatttccagtgacaattcctggaaattcggttaaatttcaatttaattacgaccaaacgttcggttaatttggactatttagatattcgttggcgatgatgcgttcgcggtaatcctaatagccatcgaatatcattacccgtaaagttcaacttcaagaattcgccactttgtccctgttgatacatggtcggtaatacctggtcttgcaacttgatcacttgctgtgcgatctcttcgtcaaataaatattgccgtgtcgcggcagcaatttcaccgaccgtaaaaatctgagcagcgttagcaaatatctgctctttgctcagcgccaactgggcttgtttaaactgggcgtaggactgatccaagacttggcctgcttgagtttccaatgcggttactgtggtcatgatgcgcacctcctaaatttatccctattgtaaccgccaccgctgactttgaccacgctaaaccatgctttttaaataaaatttgctatactaaaatgacaaaggggaaattaacttgacgaatacagacaatcgttattatcaaccaaccgacatcaaagatgcacttcaaacaattcaaaaattatttaatacttataccgatgccccattaacacccgaattaatgacttaccatcaaaaattagttaatcagttagctactaatttattaccactagcacaacaacaacatgacaaattacggatcacccaaattaattcaatgatggccgttatgcaagattggctaaaattaaggctgaatggtcaagtcttcggcggcaaaatgcaacacttcaagtttgtcagcaaccaaaaagcacagtacaaacgacgagtgcataaaattcgtggcaatcaaaatcatcgtgctagtcgccattgatgaccaaactagacttgcacgactagcattttgcggtatactaaaagtgtattgggcccttagctcagttgggagagcgcctgcttcgcatgcaggaggtcgtcggttcaaatccggtagggtccatattaatagacgtcaaaaataaggtgtgttgcaatcaactttcgattgcaacacaccttattttttggatcatcatttatttatatttatcaaagtaacggtctgttattttaacgaatgtactaaattattttcgtttctggttacaagacgctaaaagtatttgattttacatgatatcgctttttttattttaccttcaactatgctccagctcgcaaccacgcattcgtttccttgtacaatcgctcaacttcttctggtcgatccgtccctaataaatcctgactaatttgaccaccggcagcttgtcggacataggctaggaattgatacgaggaccgtaaaccgttaaaatcttgaggtatcacgtgtaaatcctgtcccacaatgactggtcgtaaattatcactttcgttaattgaggtcaatcgactaatcttccacttagtatcacggcgttcgacgcggtaaatcagtcgccgatatgattctaattccgctaaagtaccattgaccatcatgcacatatgcgtcgtggttggtagttccacgtatgccttatcgccattcagatgaacgacaggcgtactgacgctccccacaataacaaagcgcggatcaacttccttcgattctgcgccaataaatgtacttagtggtccttgttgccaactagttgccacagtcgcgtcggcgtaatagcaatctcggatttcagggttatgccgggcacgaaataagcgctcacgggccactagttcactaattagtgccatatcagttccgttactcattgacgatttcctccaatcattttagcaatcaccggccgacatttcgcgacgatcaatgacagcgctattcaaaaaccaatgacgatgccagtcgccacttaatgccgtaaatggtaccggcgtcttcccgcctgcttccaccttttcaatcaaataattacgtaagatccacggatcgttcaaagattgttgtgttaagtcaaataagtgatcgagcttagttgaactaatccctaaatcatcagctacctgggctttcgtaagaccagtcaacgcaaagttagcttgtaattcatcccgggttgcctgcacttgttgtgcgtttaatgacattatttcgttcctcctataatttaaataacgtggttgccgtgccaaacgcgatttgagcccgttgttcatcggtcaagtcggcgatatccaggaaacttccactcgtctccggctgcttatacgggtaatcgatcgaatacatcaggtgatccgcccccatctccgctaacataaattgcaactgaggcgcactcaaaataccacttggcgtcacgtacacattatgccgataataagtactaaacggatattgcaagtctgtatatgttgttaactcatcatccaaacgttccaaaaatagtgggactagttcgccccagtgtcctgaaatgagcttcaaaccaggcaacttatcaaaaataccactagcaatcatccgtatcacttgaatcccaacatccatatgccaaccataaccggcagatgataagatccccgtgacaacgtcagaccattggttactttcaaaataatgactcgttactgcttgcggaataaatgaggggtgaaaatacacggggacatcaagcgtcgcagctgcttcaaagattggtaagaagaatggctcatcaaaaaatttattctgataatttcccttcagcaacacaccccgtaatcccagcgtcgtcaccgctcggtttaattcagcgaccgcagcttgcggatcaccaactggtagaacggctaacccagcataacgatcaggatgagctaccactgctttcgctaattcatcattagctaattgtgagagtggaactgcttgttccggcgataagttctgtggtgatgaattaccataagataacacctgcatatcaatgccatattgagccataaatgccagacgttcatgctgggtgtcttgcataattgcaggactcggtaaattgtcccgcatgtactggcgtagcgctggactaactgctggtaacacagcgttaccaacagcttgacgcattgcggcagtcacagctgccgattcaaaatgctcttcaacggtaattaatttcattagtccacaatctccttaattggtcagttatatctaactgtgacagctattatagacgctttcatatgctaaaaaagggacgttttgagacatatcgtaatctggtgtatcattaacatatgacaaaattaattatgaacaatcaattgcatattgatcagcgaactcatcaaactcatcgtaaattgattactgccctgcaagcgaattttaaggctcaaaagtccttcaacgagttgactgtcaaacaactttgtctggatgcccacgttggacgtgccactttttatcgtcatcaccaggatattgaagatatcattgtgattgaatacttaattgccttacaacaattaggacaagcgttgaatgacttaacgacaacatcttacgcgaccattactggtgcgatcgtcacgacgattcgtgcacatctgggcctccccttactcgtgtcatgggcccagtgtcgcgagcgggtcatcccattagaggttggttttgcccaacagctactaactagcttagccatccatcctaagcaacggcattttatggcaacctatctcggcaactgtcttcaccagttagcttggcaacttgcaaccacacagccaacactcagcaaaattgagacttaccggctatttattcaattaattcctaatgtcttacaagcaccaacgattccaaccgactagtccgtttagtgattaggatacacaccacgttagtttggccgcctacccctgatgctggcgaatgtcgtcattattcacacccgccgcttgcctttatttgacgctacccgtatcaccatgtacgctaacaatatcaaacaatttatggaggaaatataccatgccaatcaatcccaatcgcgcccaagatgtctggaaagatgtcggtgaacacgttcaatttaccgttcttcaattaaatcggcagaatcagcaacacgaccgggaagtctttcaggaatttgcagatcggtcacaagccatcattcgctcattacgcatccgggacgccaaacctgaaactggtacccaattaaaagttagcatcggcatcagtagcgccgcttgggattacctgtttcctggcgcacccaaacctaaagaattagaaacctacaccaccttaagtggacccaaatacaccatgccagcaacacctggcgacctctttttccacattcgcgccagcaacgaagcagtcgtctacgaatgtcaaacgcagttccagcgggtcttagcgccaatcacgaccgtcctcgatgagacgaagggctttcgttacttcgagggccgggccatcattggctttatcgacggtacggaagcgccggccgtagaagatgccgctgattatgccttagttggtgacgaagatccccagttcatcaacggctcttacgcctttgcacagaaatggcaacatgatatgcccgtgtgggaacatatgcacaccgaagatcaggaaaaagccgtgggccgtgaaaaattcagcgacttcgagttagaagacgaagacaagtttaagaatgctcacaacgttgcttcaaaattggaaattgatggtgtcgaacaaaaaatcgttcggatgaatgtcccgtactccaatccagcagctggtaacacagggacctacttcattggttatgcccgtcactggacggttaccaaaggcatgctgcaaaacatggtcgaccaaagtgactttttactaactttctcaactttactatccggacaagcgttcttcatcccatcacgtgacctgttcgctcaaattgcagataatgatttttaagctattactagcgtactcgttttgacgttaaggcttcgactaggaacacgctgttaaaagaggcagtcttgattggtacttaatacataccgatcgagactgcctttatgttgttttaactttagtttaacggtttattcacgaacaatattgacagcagcgaactcaatatcgtggctttatattgattatcattccttttcacggtaactggcaaccaacatctgctatagtagtaagtaaagcaactatcaggaggtatcatttatggcaaatcgctatttacataatgtccaaggtttgttcgacaccatcgcgccgaactatgatcggatgaataacatcatcagtctcggaacgcatcgtcattggcgcaagcaaacgatggcccaaatccatttagcgcctaacgcccatgttctcgacctctgttgtggtacgggtgattggacgatcgcgctggctaaagaattacaggcacccggtgaagtcatcggattagacttttcagccccaatgttaaaactggcacaacaaaaagtgacccagcaacaggttgccgatcgggtctggttgcgccgcggcaatgcgatgcatcttccgtttaaggacaacacctttgacctcgtcacgattggcttcggactccgcaacttgcctgataaagcccaagctttaactgaaatttatcgcgtactaaaaccgggggctcgcttagtctgcttagagacgtctcaacccgatcagccattgattaaaccggtctggcagtggtatttcacaaaagtagtcccactattcgggcgcttattcgcccatcaatatcaggaatattcctatttacaggaaaccactcgtcactttgcaagctaccaacagttagcaacgatgtttcagcaagcaggctttcaaaatgttcacttccaacggttcaactttggggccgcagcggctcactttgggactaaggaggccaagtaattggacgaactgaccgctttcaatcaatgtctggcttggttgacacacaccaccgtcttgcctgagcacctcgatggcctggtcctttgtggcaacagcctcccagcaacagccactgcagcgggccagttagcccaagactatcaattaccactactcattattgcgggcggcatcggccacgccactaagtatttgcggcaaaacttaaacctgccaaaatctcaagctagtgaggctgagttgatggcgacgcttgttcgaaagactggctatcaaggtagtatccgcctcgacaagacttctaccaatactggtagcaatgccacgcatgcccgcgcgttagcccccaccgattggcgccacgtcctactcgtacaagacccgttactcgcgcggcggactaccctaacgttctcagccaattggcccaatgccaactttattcgctatgcgccggcgaccttgcaattaaaccagctacaaccaatgcaatttacgccaaccacagcattagctggctggcaacccgcttatttcactgaactcttactcggtgaatttcaacgcttagtggatacccccaccggttatggcccccgtggtcagggcttcatcgcccacgtggatattcccgaaaaggtgctcgctgcggcccggtatttacagtcgcaatcactacaccgccagcgttaacgtttatttttaaaatctagtagtgccaccaaaaaatcccgtttcactgtagcagaacatcgcgacagtaaaacgggatttttataagattaattggttacgatttaaaaacatctggatactgtgttcgcaacgcttgtgctgttaattcgcccgccatccgggaaccggctaaatctaaatgcaccccgtctgtggtactgagttgccaagtcgccgtttcaatgagttgcaattgcataaattcggccacgaccgcgcgaataatcgccgcaaaattctgattaaacgggatcattacagcaagccggctattcgggtaaagcgtctgcacctgattaagaaagcggcgcaaaactaccgtgaacgtcgtatcatccgtatgccgatcattagtaccaacattaatcacaactaaatccgtgggtactggttgccacgtcgttttactatccacggctgttaaaacctccggcagtaccggtacgccaccagttcctggtttactgagaccaacggcactataagcaatgcggacattccgtgcattcaacaagtcactcgcaaccgccgcatagttggcttccgcgcgataatcttcggcagggtacttacccatgacccagcaaccggccgtcagtgaatccccaatccacgtcacgctgtgtcggcctagctgaactggctgtaactcaccatctgtcgtcagggctttcactgcaaaaccttgattgccatcccacacatggtcctcatcagtattaccactcaaaactacccgtaccacgtgaggccgaccatccagtgtcaaccatagggggtcattcgtcaccgcctgccgttgaaaaggcaagccatcaatctggatcgccacccaactcggtagctcatacgccaacggcaagaatgtcaaccgcacaaaactagcatcagtgacttgaaaatcgatttcagcacccaaattagtgctatacatcacgtctcgatccgcaatttgcttgaccgcccaacgcccctgaaagtatgccggcatcaagggctgattggcctgcgttatttgataatccacgtttttccctcctatacctcttgtttactcaaacttgatcatcctacctattcttccgttaacttgtcatgaaacatgattaaaacatgccattttttaaattcaaaagcagccagcttagacccactggaaacagttcgggttagcgtaaacctgcttagttcgttcgtcctacgccgacctccaggcatttctgccaattgccggaacgtggtgggcacagatttgagccgaaaaaacacgtcttaaatactggcctttcactaaccaagcaaaggacgcttgctaagtgaaatttcaccactgggcattgtcagaaacgccttccagtcgggacagtattcgaatggcagacggagatgtacccaacttttattggactcatcatttttctttataaacagtaattttgtcgagcaactgtcaggtagaaggtaacattttgatagctcactatttcgaaatcactatagtaataatcgaacgtctcgacaaagtggttaatgtaaccttaaagtctcgtttaaaattccattatcaaaatagtcaacgaccaattgtaccaagttaagtggccgttcatctgccattcgagcggcttcccgactggaggggctggatggcaatgctcagtagccaaattattcttagtcggaagtgcctttcttccggcttagaataagactcgtatttgagatgacgcggtttgtgcgttagctcaaatcgacgtcggctgcgttccagcaattgtcatccagccccggaggtcggaatagaacgctcaccggctgacgaacagtaagccaactaaatggcatgttttaatcataatcactgccagcaatccagaattaatactgttatttttcaaaacttgacgcctatcaagttgccatcaagctgaactcactatactagggtcatcaaatcaaataaggagttgcaaattatgaaattccaattatttctcactaaacatacgaatcacattacattagttacggggattctgattgtccttgggatgctcagtaaatatctcttacaatttacgctcggttaccaagtcattttagcagttgcttcaattattgccgtcattccgattgcggttcgtgcttggagcgcacttcggaacaaagttttcagtattgaactgttagttagtatcgcagtgattggggcattcattattggtgaattcaacgaatccgcaatcgttactttcctcttcttgtttggctcctatctcgaaagcaagaccttgcagaagacgcggaccgcaatcaaaggcttgactgacatgtcaccaactaccgcaactttagttactgatgatggcaccgaagaagtcgacgttgatgatgtggacgaaggtgacgttgtcctagttaaaactgggagtcaggttcccgttgacgggattgttgttgaaggtaacggctaccttaacgaagcctcaattacgggtgaagcacgccaaatcaacaagcaactcaaggactcggtttactccggaacaatggttgaaaatggctatctgaagatcaaagcgactcaggttggcgacgacacgacttttgccaaaattattgaattggttgaagaagctcaagataccaagtccaaagctgaaaagttcatcgaccgctttgctcaatattatacgcctgccgtcctcgttttagcagtcttagtcttcgccttctcccgtgacttccgcttagcaatcacggtactggttctcggttgcccaggtgctttagttatcggtgccccagtgtcaaacgttgccggaatcgggaatggtgccaagcgtggtatcctgatcaagggtggtgaagtcgtcgatacttttgccaaagtcgataccctggtcttcgataagaccggtactttaacggaaggtaacactgccgttacaaccatgcacacttacacaaacaatgcagataatcaactagctctcgctgccgctattgagggagtttccgaccatccgttaggccaagcaatcgtcagttatgccgaccagcagtcagcgggggtcgctcccgtcctagatgacactgaaaccgttaagggccaaggaatctgtgcacaagtcggtaagcaagaagttgtcattggtaatcaaaaaatgttgacggctcataatatcaaactaaatcctactcaactcaaagatctcaatgatttacaagctggtggtcaatcaaccgttatcatggcagttgacggacaagttcaactcatcttcgggattgctgatacgattcgtccaggcgtaaaggattccctcgccgcattaaaagcccaaggaatcaagaaactcgttatgttaactggagacaatgaactcaccgctcaagccgttgccaacgaattgaacctagatgaagttcacgccaacctcttgccagaagaaaaagtcgaatacgttaagaaactaaaagcagccggtaacacggtcgcctttattggagatggcatcaacgacagtccttcaatcgctaacgccgatatcggaatcgcaatgggtagtgggactgatgttgccatcgacacatccgatgtcgtcttgatgcaatcaagtttccccgcattagtacacgcccacggtctcgccaagaaaactgtcttgaacactcgtgaaaacatcttcatcgccattgccaccgtggccttcctactgattgggctaatcttcggttatatctacatggccagtgggatgtttgtccatgaggctagtatcttagtcgttatcttcaacgctatgcggttaatcaatttccaaaccaagttcgacaaacaccaaccaactaaaaacattcaagcagccacagcttaatcaagtctccccaacttggttacaggcctagcaaccaataacggtccgccgactagtcttccccagctagtcggcggaccgttttatcatattgcaatcaaaaatgatagaccaataataatttcataaatacgctcggttaattaattgcgattataaaccaaaaaagatcttataaatccaaattccaataacggcaccaacaattggggcaaccacgggaacccaactatattcccagtgagaaccacccttgttcggtactggtaatagtgcgtgtactaaccgtggtcccaagtcacgggccggatttagggccggaccggttggaccgcctaacgaaataaccatggcagcaatcaaaagtccaacgccaatattggcgatatcgatattttgatgaaaaaacatcccgcgatataatcccatggcaccaaaaatcaggactgcggttcctaccatttccgtaacaaaaccgtttaactgactgttcgcatgatcactagttgcaaacgtccctaagaccgcctcattatcagtcgtttgccgataatagggccagtacagtgccaaaatcaagcattggcctgcgattgctcctagaaattgccagattaagtaaggcgcaacgtgcgcccagggaaagattccaatcacggcttgcccaatcgtaatcgcggggtttaaatggttaccagaaatcgagccaaacatcatggctgggagcatgacccccagtccatatcccgatgcaaccaggagccatcctccattggcgagtcctggatcatcgttaccagtcgtgttcttcaggaacgcgttagcgacagcaccattacctagtagtactagtatcagcgtgccaaaaaattcagcggagtagcgtgcttcccatgaacctgtcatctgtaaatcctcctcgtaaggtaccgagcatctatgataatttgaagataccagataaaactgtttatgtaaacgctttattttgcttaaataagcggtttctaataattcaacataattctaccagataccctgggttgtataattatgaagcgctagtataacgcgctcgcgtcaacatgagatcttcaacgttaatgctcgcgatcacaactagtggattctcaggagacgctagcttccacaacgaatcgttattatctaatcacccaatacatcagtcctttttaaatccctccacggccagaagcagaacacttgctcgtatatacccatgagggtatattatttagtgacaaatacttactaaaggagtcagctaaaatgattaaagaaatacatgatcaagattttgccaaagaaacagatactggtatcgccgttattgattttcgcgcggactggtgcccaccatgtcgcatgatggacccaattcttaagtccctttctgaagaccccgcttacaaggaccaggtcaacttcgtttcattgaacattgaccatgaccaagctacggccagtcaattccaagttcaaggaattccaaccttcctgattaagaaagatggccaagtcgtcagtcacatggtcggagcacgtcctaagtctgattttgaaaccgaactcaaaaaagtacttgcctaattacgaagggggcatcatgaatcatggcaactactgaagaatatgtcactagcaagcagatcaagacccggctgaaacgctcggctggtcaactggacggcgttttacgtatgatggacgaaaatcgtccttgcgaagatgtcttagttcaactttcagcagtgaaatcaagtatcgacaaggccatgaaactcgtcatcgcccgtaatattaataattgtgtagatgcgatgaccacggctgatgttcagaatcttgaacactccttggatctactgctaaaaaccaaataacgccaaaaaagacggtgtcgccaatctcagttggttataccgtctttttagtgccagttgactcagttaagcaccgtatctgtcaggcaacttatcgagtcaatctttccaatcgccctttttccagtcatcatgattccaatcatcttttttccagtcatcgtcgtcatcactgtgggactgctcggcatccttgggcgctcgttttgctcgcttcaacagtaccgccgttgaaatcaccgttacgaacccagtcgcaataataaagacaaatgtccacatcacaatgtcgctaatcgccatctcggggccctcccatataatttaattgtcgttagtatagcgcaggcccgttgtaatagcaaaaacgccctggatagtttgcccacacaatcgctatccagagcgtttaattcttcagcgacaacgacctaatcgtcgtcatcctcatcttcttcatccaaaccagttcgagcatcgttaccaagataagcttgtaattcccgaatattgcgattgttactgccacgataagcaactaaccaagccgccagcgccggccgggtttctttttcagcaagcttgatagcccggtcaacgaataggttttccgtatcaaaatccttgattgttgcggccacgagttcatcagcagattgatacttgaaagccccattttcttccaacatggaatacttggttaattcagccgttgtggaagatggcttctggttttcatctaggagtaattcgcctaattcagcaaactgacggacattctgatctaacaaacgttgatatgctgtccgcaatgccaatgattgtggtcctttaacgtaccacttcacttgggtcaacttaacgtaagcaaccattaagttagataaaatgtgattcgtcattgcgcccgctgttgggacatggtgatcaatgtcactctgttttaattccgctgcgtattgttcgtcgatcgttagttcactcatcgtttattcctcctacttaaccttgacgttttcaacttcgtaaccaagtccggtaacaacttgtgccaaatcatcggcattcgtcacttcaggatcaaagttagccttgaccttgctggcattgaatagcaccttaacattttcaacgccgtcatggttagcaacggccttttcgatcttggtcatgcatgatgggcaagtcaacgttcctaattgcataataattttcataatcaattacctccgtgtcgttcatttgatggttctatcataaccggatttgattgaccagaacttgacggccgtcaagaaattcaaaaaagttttacgctacaatatagttattaaaacagtaggaaatttaaaacgtcaaaccctatctaccaagcaaaatctgttatagttagggtgaatttattcaggaggtgggccttatggcagaacatgaatgtgtgcagttagtcccaatttttagcgaactcggtagtgaacaattagataccatcgaatcgatcgttcgtcaccaccactatccagccggcagcactttatttggtgctgacgatccactggattcactgatgattgttgccaatgggcaggttaaagtctatcagctagctgccaatggtcgcgagcagttactatatctattacaaactggtgatatcgatggcgaagctgccttatttgaaaatcaacggcgaacctcattcggtgaagccttagtaccgacggatgtttgcagtattcgccgttcagactttcaagacttgatgcaaaaatatcccagtatcagcatcaacgtcttaaacgtctttggcaaacgtctcagtcaactggagcgtcaaacaaccagcacggccactgaatccgtcgaagcccgtttagcgaactatatcactgaaacagcggcagcgctcaaaaccgacacgtttaaactaccattaaagaaaaaggacctggcgacgttcctcggcaccacccctgaaagcattagccgtaagctcgccttattcgagcgtcaaggcctaattacgcaaaagcctggcaagatcatcgaaattaacgatgccgaccagctattattaactgaataatgactactaattaaattatccctaatcccccggatgactagcgaaatcaccgttagtcatccgggggcttttacgtcaaccatcacactgcctcataagttgatttacaggcactaacagctcctgcatgccgataattcagaagtaatctcgccctttacattaacattcacaacccatccgctactgattcgggactattaagatgattagtatcattttttactgagtcggtaccagatgataccactgagaataatctaaggtataattaacttagtattagaaaatttattagggagtggatttaatggcaaccattaatcaagcagcagtaaaacaagatctctacgatgccgtcaacggcgagtggctcaaaaccgccgtcattccggatgaccattcttcaaccgggggctttatggacttagttgatgccattgaaaaaacgttaatgcatgactttgatgcaatggcggcgggaacagttacccccgacgatcctcagctaaccgaattcattaagttttaccgcttagctaaagatttcgaccaacgcaatgccaatggtgcggaaccaattctgccgtgtctcaagcaaattgatagtttaagcgactttgctgacttacaacaacggatgcccgattggatctacgacggcctcccattaccattcagcttggatgtcgacgctgatatgaaaaataccaaggtcaacgccttatttgcccaagcacctgggactatcttgcccgacaagacatactacgacgaaggcaaccaggccggccctaagttactagcaatttacgctaaaatgatgaccgaactgttgcaaaaaactggttacgaaaaggacgaagcacaaaaaatcgttgatgacacgctgcaattcgatcgtttgatcgttccgtgggtcaaatctgctgaagagtcggctgattacagtaagatgtataatcctcgcaaattcaacgattttgttaacactagtcgttatttagacttagccgccatcacctactccgtcatcgatggtaatcccgacctcgtcatcttgccagaacccgccttcttcgatcactttaacgaagtagtcaatcctgataacttcggtctgatgaagaactggatgaaagctaaactcgttcaacggtacagtggttacctcagtgatgaaatgcgggtattagccacgacttattcacgggcattgtctggtcaaaaagaaccgcggaaccaggctaagagtgcctactatctagctaccggaacttttgatcaagtcgttggactctattacggccacaagtattttggtgaagcagccaaagcggacgttcatcaaatggtcgaaaagatgattgccgtctacaaacaccggttgcaagcgaacacttggctcagcgcagatacgcgtgctaaagccgtgaccaagcttgataaactcggcattcaagtcggttaccctgataaattagaaacgatttacacgaaattcaagacgcacacgcccgaacaaggtggcaacgtattgagcaacgtcctccactttaaccgtttggcacgccaagacatgttctcaaagtggggcaaagccactgatcggacccgctgggaaatgagtgcggacaccgtcaatgcttactaccacccatttatgaacattattgtctttccagctgctatcctacaagcacctttctacagcctagaacaatcttctagtgctaactatggtggtatcggtgcggttatcgctcatgaaatctcgcacgcatttgacaacaatggtgccctattcgatgaattcggtaacttgcataattggtggaccgaggaagattccgctcacttcaaggaacttgccaagtccatgatcagtgaattcgacggcttagactttgctggcgcgaaagttaacggaacgttgaccgtatccgaaaacatcgccgacgctgggggcttaagttgcgcggaagaagccgctaagggcgaagatgacgttgatttgagtgcgttcttcactaactgggccatggtttggcgtatgaaggccacgactgaatacatgcaactcttactttcaatcgacgtccacgctccagctaagctccgagcaaacgtacaacctaagaacttagatgatttctacacaaccttcgacattcaacccgacgatgccatgtatttggcaccagataagcgggtcaaaatctggtaaaaaactttaatcaatgaacactaagaccgactaacaagcggtgcgattgcttgttagtcggtcttttatctgttccatcattatgggtcttattcattcaaattacgcgttagtatattacaatagaactgtcgtctgatgccgttacatcgttattggactgtgacccagtctcaatcacgactgcaccgcaaatcacaccagcagacgtgttattagccgacctaacgccattttcagcggggcccatcaacaagcaaccccagtccacttgacgcttaaatcggcatatttgggcactggtaaccatcgaaaacaactagcattaactatgattaaaacgtgccggttaggtggattgctgttcgtcagccgatgtgcgtcctattccgacctccggggctgggtgacaattgctggaacgtaagccgacgtcgatttgagcccgtgcacaaaccgcccggtctcaaatacgagtcttattctaagccggaagaaaatcacttccagctaagaataatttggctactgagcattgtcacccagcccctccagtcgggaagccgctcgaatggctgatgaacgaccacttaacttggtacaatttgtcgttggctattttgataatggaactttaaacaagacgttagggttacattaatcactttgtcgaaacgttcgattattactatggtgattacaaaatagtgagctatcacaagatctttttcagtctgacagttgattgacaaaattgctgtttatgaagaacaacaaccaattcatcaaaagttgggtacatcgccgtccgccattcgaatactatctcgactggaaggcgtttctgccaatgctcagcggtgaaattccacttagcaagcgtctttggcttggttagtggaagaccagtatttaagacgtggtcttcggcttaaatctgtgtccaccgcgttccagcaattggcagaaatgcctggaagtcggcgtaggacgaactaactaagcaagtttacgctaactcgaactgtttccagcgaacctaagccggctgattttgaacaaattcttatttatcattatccacataatttaaataatgaatggggtcatgtagatatgatttatgcacaaatattagccggcggtaaaggaactcgtatgggcaatgttccgatgccaaagcaattcttactgcttgccgacaaaccaatcttaatccatactattgaaaaatttacgcttgaaagtcgctttgacgccattttagtcgtctgtccagccgattgggtcagccatactgaagatatcatcaaaaagtacatcaccgatgagcgtgttcacgttgtcattggtggggccgaccgtaacgaaacactaatgagtggaatcaactatatccaagatcattacggtattcaggacgatgatgttgttgtgactcatgacgcagttcggccgttcattacacaacgtatcattaatgacaatatcgtcgccgttttagagaacaaagcagtcgataccgtcgtcccagcaatcgatacaattgtccgcggtactaatgatcaagtaactgatattccggttcgttccgaaatgtatcagggtcaaacacctcagagttttcacatcaaaacgttgatcgactcatataacgcacttagttccgaacaaaaggcatcactgtctgattcgtgcaaaatctgctcgctggctggtcaaaaggttagtttagtacgtggtgaaaattataattttaaaatcacaacgccgtttgacttacgcgttgcatcagcattagtagaaaagaggtcataagatgttaaatcaagtttatcgtttagtgagtccccgtcaatttgaagttgaaaccgtcgccgaagaggtagacgccgatgatttgatcgtgcgaccaaagttcttatcgatttgccatgctgacacgcgttatttctttggtcaacgctcccaagccgcattacgtgctaagctacccatggcactgatccatgaagctgtgggtgaggttgtttatgatcctcaacatgagtataagcctgggacgctcgtcgcaatggtccctaatacgcccgttcagaaggattcaattattcaggagaactatttaccttcttcaaaattccgttcaagtggctacgacggctttatgcaagaatacgtttgtttacgacgcgaccgcgcaatcagcgtgccaagcgacttcgatccacacatggccgcattcattgagatggtctcggtcggcgttcaagcattaaccaagcttgaaagtgccatggatgaggaccaacgggttatcggtatttggggtgatggtaacttgggctatattacagcgaccctggttaaacaaattttcccagacagtcagttgctggtattcggtcggcatcaatccaagttagattatttctcatttgcagataaaacttacctggtcgatgacattccagccgatgtccaggtcagtcaggccttagaatgtaccggcggccagggcagtgaagcagcgattcaacaaattatccagcatattcaaccgatgggaactgccattctactgggcgtctctgaaaacccagtcggtatcgacacccggtctgtccttgcagaaggattgacgttacgaggcgtcagtcgcagcagccgtgaagattttaaacgtgccgttgatattttatcctccagtccagtcactcgcgaacggttgcaaaatttagttggctacgttcaaaaagtgagttccattcaagacattaccaacttctttgatagtgcacttactaattattggggcaaggaggtgatggaatgggacgtctaaagacggtaaagctcgtgttactacacacgagctttaatttattctatcaatttttttataaagtgtttggcccgaagaagggacggatcacacttgccacgatgcgcagcggtcaattaaacgacaatttggcagctcttgagcagggcctaaaaactgccaacgttaaaccggttactgtgttttgctatcattatgaccgcaccctggttggaaaagtgggcttcttgctcgcctccattaaagcgctatacgtgattgccagggctgacgtctttgtgatcgatgattacttttttccactttacgcaattcacaaacatgatgataatcaagtggtacaattatggcatgccattggttcattgaaaaagtttggcctcagcttaccgaatgctgatcagagcgtcatgaagccgcacacaaattatgattgggtcttgatcaatgcaaagtctgatcagcctgcttatctagatgccatggctatcaatcaagatcacgtcattgccactggatcgccaatggtcgactcgttgcttaatcgacaaccacaacaaccgcggctcgccgcccgtcgtattctatactcaccgacttatcggcaaggtgtccagggtaagcagcaagtcatgggatatgtcaacaacatgattgcggcctgtcagcagctgaccggtccatgggaactgtacatttcgctgcatccgtacttaaaactgtcagcgatgacgctaccatccaacgtgcatatcttccaagatgctgagcgggttaagacgctgatgccaacgattgatttatttataaccgattattcgtcattatcattgacgtttagttattttgaacgaccaatcattctgtatacgcctgattatgatgattatatgcaaacatccggattctatgtcgactactatcaatatttgcaagcaccgcacttcagcgaagcggcgcgagttgtcgattttattaatcaggaagttgatcatatggatctatcttatgtacaggaattaaagcaaaagacatttccacatcaagatgggcataataccgaacgggtcgttcaatttgttgaaaaactagcagggggagaacattagatgatacaacgactaaaacgaatcgcacgtcgcatcgtatacggacggaatcaaccgcaatacactcgtaatcgtgaattggttgaggacgcacaaacgactaaggaagacgttgattttctaaatacattgcgaattgagaaagatgccgaatcattgatcaaacgtcaagtgactaagctggaattcaacagctcttacttagtgattgagggcatggcgtggtttgaaaagtatcccgaacaagatactgaacgaattattaaaagcttaattttgaccagcaagacgaatgaagaattagaaattccgttgatcaacgttcgtggtcaaaacactgattttccttatgctgggtatcatggtgacatcaacttttcaacactcagtgagggtaagccattaacaccgggcacttatgaaatcaaaatacaattaaaacagtatctaggcaacggttggattatcagacgaacctccattggtcaagtggtggaaacacagcaagacttaaattatacgactaaaatgacaagctattcagcgaaaagcaataagtcatacagtctgatcttccgctataacttagccgcccaagccttgaaggtcacttcatataaactgagtgatgttaatccgctcgaaaatgagttcaccgaagatgtcgggttagatagtgcggcgatgcgtgctataaagcgccgggcactaaaactttggtaccggtggtattgtcttcaaccgattcataagaaacagatttcatttgtttccgatagtcgggtgacgatttccggtaatttcgagtttatctaccaggaattaaaacggcgcaatactgattttaagatttcattctatttgaagccaagtatcaagaccaaaaaatcctggaaagaggtccgcacgttagccaaagcgttggctactagtcgctatgtgattttggatgacttttacccgttagtttacccattgcatatccgtgaaaatgcggatctgattcaggtatggcatgcggtcggtgcgttcaaaacatttggttacagccggctggggatgcctggtggtcctaagattcaatcgctaaaccatcgcaattatacgaaagccttggtttcttcgcataacattgcggataagtacgcagaaggatttgggattgcaccggataagattcagccgctgggaattccgcggacggatatcttttttgatgaacccaagaaacaggcaatccgggaacggctagagcaagatttaccattcatcaaaggtaaaaaagtcatcctctttgccccaacgttccgtggtaatggtcagcaatcggcatactatccctttgaaatgttgaatttcagatcaatctacgaagcgttacatgaagattacgtctttttactgaagatccatccgttcgtgcagaacaaaccgacgttaccatatgaatattcggacttctattacgatgtttctgattatcgtgagatcaacgatttattactcgttgctgatcaattaattaccgactactcatcagtatgttttgaatacgcactactgaaccgaccaatgattttctttgcgccggacttggcggattacatgcaatcccgaagtttttacttcaactactttgattttattcccggtagtttagcggaaaacacgggtgagttgatcagccagctgcaacatccccaagttgaccaagctaaattggacggctttgtgaacttcttctttgatgatttagatggcaagtcgacagcccgttttgtggacgcacttgaaaatgacttcgaggatccgaacgcagctgagttagaaaataacgacggtctcgccattagtgaagatgggaagattatccctgattggggtaaaaaggctaaataatatgttagaataaaacagtcagtcacattgtcagcgtatttaccgcgttgatcgtgtgaccgactgtttttgctaggaatctataggagaaattgatcatgtcacaaattacgacacggcggctcaccactgctgacgtgaacaaactacaacaaatcagtattgaaacctttaaggacacgtttggtgcacaaaacacctctgaaaatatggccgcatacttacaagatgcatataacttgcccaagttaacccatgaattagcggaacccgaatcacaattttattttgttgaacgagccggtgagtcattaggatacttgaaattaaacaccggtgcggcacaatcagtagcaatgggctcagacactttagaagttgaacggatctatatccgaaaagcattccaacaccaagggctcggcaatcaatttatgcaacaagcgattcaaattgcgaaagctaatcataagcagaaaatctggcttggcgtttgggaacataacgaacccgcgaagggcttctatgcgaagtggggctttgaacaattcagtgctcacgattttgtgatgggtgatgatcgccaaaccgatttgctcatgatcaagtcactgacccaagactaagggcagtaagtgcttttgagtgaactgcttttacaagtttagaattagtcgctgtctgtggcgaccagcagcttacaaatttatttaccccttgttttttacgggcaaggtgcttatactgataatcaatcgtacacgattgaaaggagcatccgcatgacaccagaaattgaccttgctaatcaactttgttttagcatatacaatgccaatcggttatttaacaaattttatgtcgaagcgttaacaccattcaaactgacttacgcacagtatctcgtactgatggcattgtgggaacatgacgaccagtcattacacgagttaggtcaggttctgcgcttaagcagcaacaccttgacaccgcttttgcgacgcatggaagacgcagggtggttgcagcgcgagcgaccagcaacggatcggcgccagttactcattcatctcacgacgcagggtaagcaacaacaagcaccaatcgaagccgcgattgaaacttgtatcagtcgctaccacctgactgtcgatgaatatcaacaagcactggccctgaaccagaagattattaccgcattatcacaggatttggcctaaacgggcctttttattgaccatttcagtcgtgtgcgattgaaatataattttaggaggaatctctaatggcagattatgacacaatttttatcggtagcgggcacgcaacgtggcatgcggcagtagccctagcacatgcgcaacataaggtagcaatcattgaagaagataccatcgccggaacgtacactaactttggctgtgatgctaagattctgttagacggtcccttcgagctgactgaacaactcaaacaatatcaagggattggcatcaacacaacgcccaccatcgattggtcacagttgatggcctataagcaacaagtcattcaacctttatcggtacaaatgacggccgtcttcaaacaattggggattacaattattaccggtcatggtgagctgactgatacccacaccgttcaggtagcggacagcacgtatacagcggatatcatcgttatcgggaccggacaacgaccagccaagctggcgattccgggtgcggagctgatgcatgacagtcgtgattttcttgacctaccaaccatgcctaaacggctgaccttaattggcgccggaattatctcgttagaatttgccaacatggccgtgttactaggatcagaagtgcatattattgagtttgccgatcgggcactacccgcattttattcagaacacgtcgaaaaaatgattgcacatttacaggcagccggggtgcacttccactttggtgaagcccttagccaggtgactaaaagcgccacaggattattggcaactactgagaacggcctgaccattgagagtgatgacatcattgcggccactggtcggattccaaacatcgaatacttagggttaacaaaagttggcgttaaaaccgaccgacacggcattatcgtcgacgaccatttgcggacaaacattccaaacatttacgctagtggtgacgtcatcagcaaaactttgccgaagctaaccccgaccgcgacctttgagtctaactacatcgctggccaactgcttggaagtacggctgcaatcgattatccggtcattccatcagttgtctttacgttgccaagaatcgcacaggtcggtatccctgtcgagaacgccaagcttgatactgaccactttcacgttcaagcactgccatacggtaaactgttagcctttcagtatcaaaacgaggtcgatgctgatctacaactggtctttgaccaagagaattacctcgtcggtgcctccatctatggtaatggcgcgccagacttgattaatttactgaccatgattattaatgatcacgtctctgccaacacgttaagtcagaagatttttgcctttccaagtgcttcagtggggatcattgatatgttgacgccactcttacaccatgactagtcattaaaccaactaatttaaagatgctgggtaggttgccgcctacccagtatctttttgttattcgaaattaactcactgattgtttatgactaggacgcctaataatttggcgagcaggacaatggcgccaccaagtgaccaaaggaagataccccagcttagccagctagcttgaacaaacaggctgatcagaataaaccaattcattccaaatagccaccagccaagcgtccttttcaaaattgttgaccaagtaaagggtgccgcataccgatttagtgggataatcgcgagcagtagggccggaataagcatactttcaagcatcgccaaatagtggtgcgaatcactcgtataagcgattgctcccaacagaccataatgactcggaatcatcgttaacagggctgcttgtccaatataaacgatgattggttgtccaatcaacaatgtgagtagtccccaagttacttttttcatcagtctccgccgtccttattagttaataacactatcctaccaatttacatacgttgctaactaccgaataattgtaaacttcccgtgaaaaagacgtaaagaatgggcatgattcgttcactatgttttcataacataaataataggaattttaaaaaagtatgcgtataataccttcttaataagtttctatgggggcgttatgatgataataatcagagttgcaattatgatttcagtcgttttttacttgtattttattattaacttattactgatcaatcattatcgagaacctatacaaagctatgaaaaggggcccacaccctatgagttgtttttggtcattccggtgcttaatgaagaacacgtgatctcgcgaacgattacacaattaactgaatctctcgaacagttaccaccaaccattcacgcccaaatcattgccgttgatgacgattcgacagatcacagtctgttgttattaacacagtcatcgtcgcgcttcttacaaatcttacaccgcacgggtaaccagcgtgctggtaagggggccgtcctcaacactgccgtccagtacattcataagacattggcactgaagtccaatccgcagcgaacgatcgtgggggtcctggatgcagacgcgttcatgaatactgccgatttgacacgggtactggcgcacttcgaacaagaaccacagttggccatgatccaaacgagtgtgaatatctacaatcagcccaactggctgactaagatgcagaattttgagttcatgggggttaataatgctacccaacagttgcgcaatcgccttggtcaggggattgcgtcgggaaatggacagttcgtccggctagatttagcgttacagaatccatgggggaatagcttactcgaagatctcgaatttactttgcggacttggctgttaggtggtacccgaacagcttttgatcataccttagttgttcagcaagaggccgttgaacaactacgcccattttttcgtcaacgggtgcgctggtgtcaaggcgccgtacaatgcatgcgctatttaccagcactttggcgttcgggacgcctgaaccattttcaaaaattggacacgactttttggattctgatgcctatcagtggttgtatcgtgccactgaccagtctgatcacgatagtcgtgcttgtgagtcgcagcttgcaacattggcaagttgggtggcatcatttggctatcggaacattactagtgattgccttttcagcttgtttagtattagcagcgctgtatcagcgcaactgtgctgtcgtgaaacaacccgttggcttcttggatgcgctcaagcagagcttaacctttcaagcattcctattgattattagcctgacaccatacgtcgccatttaccggcagttgcgtggtcaaacggggtgggctaaaacgcgccatggtgtcacgacccccgttgcaaaatacccagatactggcttgaaacgctcatattaagatgaaggtgcatgccgatgaagtggtgctataagatatttcaaattaccgttctcacgattgcagctgccttgctcgggtggatgattatcgccaactggcaggtcagtcggcaattacacctcgcaatcagcgcttggatagccgctggtttgttcgtattgttcattggtgccacgattggccttggcagctggtggttgagccgccatcaaactagctggttagttgcagcactgatggggttaactctcttaaaattcccactagttgcagggttaaaaatcgatcccacctcagatttctggaattaccatacgcttgccgcatttagtgcccaaggactcacctggacccaactattgcaccatggcatcgttggtaattacgtcgtttttccacacgccttaaatatcgcgagcggctacagcttagtcgcggcttttggcggggccaatttttttgtcagccaactaatcaatattgggtgtacgttagtcgacatgatcttaatttactggctggtcgcacggtggctctcacgacaattaggtatcgcggctgcactcattttttactggattccagcttattggctgtacggcacgctcttaaatggtggtgagccgttcttcttcaccagcgttttgctcatgatgtatgcgctgacacgggcattagttccactcgcgacgaccacaatcacagaccggcgactatacctagcgctggcaatcgtgacgactgtcgtagcaaacatgctaagaccaatcatgggcgtctggttaattgcactgggcttgatgagtctatgtgtcctgctcaaatcttaccaccgttaccgcgttcaagtccggcagctcctcatatacggtggggtcgtgttagggctcatgttcacagcgactaatctcgacagctggttgtatggctttaaagttgccccagcccaagttgaaactttgtacagcctggctacgggaactgatgtcaaaagtcacgggacctatagcccggcgctacaggcgaccgtcaaccatgaactacgggtggcgccgacgttgacgcaagcgtatccacgcattacccgaacgatggcgacaaccctgaagactaatctcaaacaggtcaagccacagttaggtccctttgctaatgaaaaaatgcaggggtttattcgtgaggattatggttatgattggagcttatataacttaagccaccatcccggtttgctcaaccgccactggtttcacttggcacctatactgattacaagtgcgacgatttattggcaagcaatgctggtaattgcgttgttcagcgttttaatgggactgggactgctatggcaccggcactatctcaatcgctatttgctgatgggagcgctgttactagatggtttcaccctaagtgccttaccattggaagtacagggccgctatcatattatcttgtacttaccaatccttatgttgatgacttgcggaatcgcgggggccaagctctggtggcgtcaaatcaagcagaattgagtggcaggggccatgtcaaaatcaatgcgcagatggattgttagcgttcgaagcttactgaatgaaaattaaactgatgatataaataaagattattgctgacagtagtgaccgttgcttcagtaataatctttttagcatctcgaaaaggggggccggcgtaatggcgtgggtgagcaaagccattgctatgcggcgtcatgtcaattcgtcaagctttagccaaaacgggtgtaccattgaatttacctaattgattgggtaaaactggtgctgaggcggtcttagaatgcgttgaatggaagcagcttgaaaaatagggcgaccgggtgctatttctggccgggtaggggctgccacaaaaagttgacatgaacaccaacgacctatttgagcgtaatatcgggttgtgcgatgacattgcgttttacacaattttattagacgtggtattgaaagaacccattaccctggtaaattattcaccgaacttttgatctagtgcatggccaacaaaccgatgaggccatgacgaattactgttcgtagtctgcaatgattggtgacgctaaattgaatgacacaatcagctttaataaatacgcttaatttgaggattaatggtctgaaaattaacaagttgtcaatccacaattatgactgagcacgcattattgtttaattaccgcgattattagttagaatagttgccaaaaagcaattgcaaagctaggctgtaccggctcttcatacaaccgcagtactcaaagatgcccgctcacatttatggcattcagcacgcgacctctaatataaattacgataaaatgacgtgactgccaacaagacaaattagtatcacagacggatctaacttacacatctttaacatttttagttgagtgcgtgactgaataccgtcatgatacggctttgggcgctccgtccatggcaaatcatgtcctttgaaacttgataaacaatgacgttctaaaagccggttttaaatctaaggtacgcagcaatccaagcgattgactaacagttatgcgcagtatcatcattaacacagtcaaaagcgatttgatgatgaaatggtttctgactgtgcctagcttatgaatcataatcatatgtccacagtaagtcacatcaatattattcagcagattttataaaaatgcgtaataaatttattttctagccgaaaataatcgctgtactagcagtaaacttgataacaatttacatgataaaagcggttggttggtgattatgatggcttatgtgcggattatggctaaatctagctagggggctttttatatattttttagtttacataatatatattatacaaagtagaattgaaaacaaaattgctcccccacgacctgatttaggtcccccgtgatgatttttaaattttacgttagctttctggtgactcaattcttagattgtcatttcgttgcaactattttgtcgtggctaactgttttgaactttttagcgcgtccgtttaacttaaattatttttttgagtcacagacatcaacgctaaaatcagtcgattgaatttcaaccgagtatttttcatgaatttggattagcttgtctgaatcacttaaagttcaaatactttcaaactgctaaatctaactagctcactagctggtatttatcactaacttgcatgtacgctcataatttgctgatagctaacgtcgattatacgcttcatttgacggacgagtcttcaactaataaacgaacacgcgcttagaatgcgcctctcagcatcggtcaaatcgcttgtttttgctgtaaatttatgttttagttaaagtaagaattctaacccagaaaggatgtcctactatcaatgaccgctaaatttccgtatgctaaaagctttctcgcctcattagaaactgctggcaagcaagctagtacgattgagcaatatgaattaaccttggctgactttttcaactatgagcagcacttcaatgagacctttgctaaggatcagttactagcagatttaactgagaatgatattcaagcttacttggcaatgctccgtgaacaacgtcaattcaaaacatcgacgctgaataaatgtctgtcgaatctaaacggctactttagctatttattttcacaccgaattattacaactttaccaacctttacaatcaagggacaaccattgactaatcggcaacaaacaacgacttggccagagcaattggcggcatggctagcaatggatgacctgcatccatacacccgcttatttttgttactaacgaccaagggttatactgccacggagatgctcacaccggggttttatcagcaattgaatacaattacctttacagcagtagaacaggcttttctggttaaactacgggcctatttgcagccattacagactcaaagtggtagttcggaccttttcttaaagcagcgtcaacgtgggaccgacccacatatcactctagcagcattgcataaatacttggcgggtgatagtcaacgtttaggtgtgccattaaagccggttgcactgcgccaagacttcatgctgtggtttctcaatcaacaccggacgaccgaaccgactgagatcatgcagcaactgcggttagatgaaaccagcctcgaatattaccaaaacttgctacgccaacgtgatttgcgcactttaaaagccactaaaacagattaaggcaacactgataagctaactgcgacggttagcttttttagttaaagtaactttacgttgttgcacgatctttacataactttacaaacacatcacaagcattacgtggaatttgctagttaattaagaagccttaaaacgcctatacaacgcgcctttttgcagttaaactagttttattgatttaactaaagtattgaaaggatgatttgatgacattctatcgttggttagaaccgtttattgaacaaaacggtccgttcgcaccagctgcttgttatgcgcactcagactttgattttcctttgactagtaatgttcatgaattatctgattatattacttacttaaatattcgtgactcagtcaaaaagtcgttttattcagcattggacgcttaccaagcaagttaacaatcataattaaactcaaaaaccaacctactaacccagtgacgatcgctgaagatttgcaggttggtttattcgtatttttagccgcattattgtgatgatgcccagtgataaacagttctccaataggcgtcattctaagcgcttaagccaccattacgtttattgccaatgttccttaataaacgcctcacgaccgcccatttcttcgatttgatagcggaatggattgcgtcgataaaagtcttggtgctcggcttctgcgggataaaatggcttcgcatcttcaatggttgtcacaatcggctcagcaaacttaccgctagctgccagtgcatctcttgaagccgttgcagctcgtcgttgagcttcactattaacaaaaattactggtcgataactgtcgccacggtcctgaaattggcccgatgcatcagttggatcggtctgacgccaataaatttcaactaagtcggcataactgattacctctgggtcaaaagtgatttcaaccgcttcagtatgtccagtcgtatggctggcaacttgttcatacgttggattagcaactgtaccacccgtgtaacctgaaatgactgacttgattccgggctgctggtcaaacggtttgaccatgcaccagaaacaaccaccagcaaatattgcagtctctgtcatctaaattcctcccgtttattaactcaattatttaaataaactctgatactgaccataaccagctttttcaagttcagcaactggaatgaacttcagcgctgctgaattaatacaataacgaagcccgccacgatctcgtggcccatctggaaagacgtgacctaaatgtgagtttgcttgtgtgctagtcacttctgttcgatgcatgccaaacgactcgtcacggtgttcgttaagattagtctgatcgattggtttagtgaaggatggccacccacaacccgcatcatatttgtcacgcgagctaaagagtgcttgaccactaactacatcaacgtaaataccttcctggtaaaagttatcatactcaccgctaaatggccgttcggtcgctgcctcttgagtaacggcgtattgttcaggcgttagacgctgtcgtaattcaccttgctgtttatccattactatcagtccttccataattgagttgtgtacaatctaattacagtatttatcataccccaatctagctagaatgcaaaaaagaagctccaacaagtggtagcttctttttaaattaatctgtaaattaagcgttgaaggcgtccgttaattgagggacaacttgcttcttacgtgaaacgacacctggtaagcttaaccggttgttagcaatcgtcttaccaaaggccttttcaacgggttccgttgggttaccaacgactaataattcggagttactatccaagatattagtagctaagattaggaataaatcataaccgtcactcgcgttttcgtccttagcagcactctctaaggccgcttggcgcttgaaaacatcgtctaagtcaactgtattaatctgcgcaacccgtacggtcttgccgaccatttcaaatgacttggcatcagcatcgattaattctttttcagacttgctgtcaaggttagtccctgctttaagcattgctaaaccgtaagtttcatagtcaatatcagcgatcttagccaagtctttaacgactgcaacgtcagtttccgttgtcgttggtgactttaagagtaatgtatctgagatgatcgcagataacattaatccggctagtttggctgggatttcaatatcattttcttggaataacttgtaaatgacggtactgcagcagccaagtggttctgcccggtagaataatggttgcgccgtatcaaagccggcgatccgatgatgatcgaccacgtgactaacagttacgtcagcaatgtcacttacactttgttgtggttcgttatggtcgacaagcataacgctatcaacttcgtcactggccttagtaatgacccgtaatgctggttcgtcaaagtaatccaaaacgtattgggtttcttcgttgggttcacctaaagcaaccgcttcagtgtccgcccccatcttattttcgtagtatgagaacgccttggccgccacaatcgcgtcggtatcaggattttgatgtccaaaaactaattccttactcattagcacaaaactcccttaaaacttatttttgattaattttttgtaaccgtgaaatgtaatcttcggtccgtaagtaagcgtcaaattcgtcaaggaaattcttgattcgtggaatttggtccttatctttacggaagacgaagtttaagtcaaacttgatggctggttcaaatgacaacgtgtgaagcttatcagttgccggattagccaccataaatgaattaggtaacgccgtgttcgtgttagttgctgccacaaaacgataaatctgttgtggtgtcgtgaaccgggcgactgccgttggcaaatcagccaattggtttttataggattccttaaccacttgatccaagtagtagttttcaggatacgtcacccatggattgagcgtcgtatctttgaacttgatgcgcttcttcttcgctaacttctcgtcacccgaaataaataacagctcatcttggataatcttcttggactggtatggtttccagttcttgatactttcatcaggtaggtacatgactgccaaatcaatccgattattttccaatcgttcccaaatttctttacgcgtcaacatgtgcaacgaaataataacattcggattagcctcgtaatacttgatggcaaaatcctcaaatacgtggtcttcaattgaagctaacaccccaatattgattgttccttgagtagcactggtcgtctgctgaatttcatcagttgccttgttcagtacgtcgtaaatgctgtgtgttgcgttgagcatcgtgtaaccggcgtcagagagccgtaactttttcccgacggagtaaaacaaaggggcgccaacggtacgctctagttttttgatttgttgcgtcaatgctggttgcgtgatgcctaaaatttgggctgcttgtgtgtaattcatagtttcagctagttgcaagaaatacgttaacgttttcgatgagaaaatactttcttgagttgtcttcatgaattttacctgatcctttcttcttatcgccatcttatgatacctataattttatacaagattcaaagtgaaagcaagcggttgttattggtaaataaagcttaactaattcataatcttttaccctgtcataacattatcttaatcgaatgccagttaacgtgcaagtattcgcattgcaaattacaccgttagcgggattggatggatctgcatagaaacaggttccccttcagtatcagtatcaactacaaacgagccattagaataacgcgcactgattggatgatcatcgttcaagatcgaatggtgcttaccacgatcagtcagcacatcaagtgcaaccccatttgcgtcactagcaactaagacataatcagcgacccggtgtggattattttttaactcccgtaagacttgaacgccccgccgtgcacgacttgtcacgggtaaatctgccaccttcatcttcttgaatgaaccccgttgcgtaatcatggcaatcaaatcatcatctgcggcgattgttgcccgtacaatggcatcgtcgcgcagatccatagatttcacgccgaccgccttcgcaccaatcgttgggacctcgcttaaatcatagcgaaggccatacccatgttgcgttatcagaatcagggttcccgttggtgcagctggtaagtattcgactgttacaacggttgcatcatcagccttcatcttgatgaactgactagcccgagtcttataagttcgacccggcgtgtaatcagcaaaggccgtttgtttgatatagccgtcactagttgccactaagaattttccggtagctttaaggttctcaaaagaatagacccacgtgatgcgctcgttttcagccagcccaatcgtctgagaaatgtgctcaccggtatctttccatttggcgtcagcaatttcataaatcggccggtaaatgagatggcccatgttggtgaacatcattaaatgatctaacgtgctatttttagctagatagatcggataatcctcatctttaagcccgttatcatcgggctcagacgctgaataagagcgtaagctggttcgcttgatataaccatcatggctaatcataacaatgacgtcttcttgtggaatcacgacctcggtcttgacctttaattcttgaatttcattttgaatctcagtcaaacggctcgttggataggctttttgaacggcctttagttcacgccgtaaaactttatcgagttctttaggctctgccagaatcagctgataggttgcgatagccttggccagttcagctgattctttttctagctgcgtcacatcggtattggttaaccgataaagttgcattgtcacgatggcttcagcttgaatctcagagaaatcgaattgactgaccaagttctgtttggcgtccttcttatccttgctaccacgaatcgttttgatcacttggtcgaggatggacatcgccttgattaatccttgaacgatgtgttggcgatccatagccttctgcaagttaaactgggtccgccgggttacaacgtcccgttgatgctccaaataggccgttagaatcgttttcaggccaacgtgttcgggccgctgatgataaatggcgaccatgttgaagttataagtaatttgtagatcggtatttttgagtaagtaagtcagaataccttctgcattgacgtcacgcttcagttcaatcacgaccgataatccttggcggtcactttcatcacgaacttcggcaatgccttcgattttcttcaaaatgcgaatttcatcaatctttttcactagttgtgccttattaacttcataagggatctccgaaacttcaatctgtgacttattccccttaagcggtacgatcttggttcgcgaacgcacgacgatacgcccacggccagtttcataggcttgcttgatacctgctaagccttgaatgatccccccagttggaaaatcggggcccttgacaaagtccatcaaatcttcaagcgttgccttagggtgattcatcaggaataaaatcgcatcaatgacttcactcaagttatgcggcggaatttccgttgcataaccggctgaaatccccgttgctccgttaactaataagttcgggaaacgagccggtaaaacagttggttcgtactccgtgtcatcaaagttgaggaccatatcgacagtctttttatcgatatcttggagcatttcaccagcgattttactcaaacgtgcttcggtataccgcatggcggcagccggatcaccatccatggaaccgttattcccatgcatttcaatcaacggttcacgtaacttccagtcctgactaaggcgaaccattgcttcataaatcgaagaatctccatggggatgaaaattacccatgacgtttccgactgatttagcggacttacggaaggctttgtcaaaggtgttgccatcctgattcatggcgtataagattcgtcgttgtactggcttcaagccatcacggatgtctggcaaggcccgttcttgaataatatatttagaataacggccgaagcggtcgcccatgacgtcttcaagggttagttcttgaatttttggttgttcagttgccattttacgaccccctctattgttttaactgttgtgccaattcttcgtcggcttgctcatgtgcggatgagacggcctcgttatctagtaacgacccgtcttcgtccaaattaaagtggacgttactttcgatccattttcgacgaggttcaactttgtcacccattagcgtggtgacccgtttttctgctaaggcagcgtcatcgattcgaactcggactaaggtccgtttttcaggatccatggtcgtttcccatagctgttccgcgttcatttcgccaagtcccttgtagcgctggagtgcatagcccttaccaaatgacttggtcttgagcgttaactcttcgtcagtccatgcatattccgtccgtaactgcttgttctgcttcttttgtaatcgatacagcggtggcaacgcaatgtagatcttaccagcgtcaatcattggccgcatgtacttataaaagaatgtcagtaagagaatttgaatatgggcaccatcggtatcggcatcggtcataataatgatcttgtcataattactagccttaatatcaaattcaggaccaacacccgcaccaattgtgtaaatcatggtattaatttcttcattcttgacaatatcagctaatttggccttttcggtattcaacaccttaccacgtaatggcaaaattgcttgaaacttacgatcacgcccctgttttgctgaaccaccggccgaatccccttcgactaagaataattcattcttcttagcgtttttagactgcgctggcgttaattttccagaaagtaaccgttcctgcttatgacgccgcttaccgtttcggctttcatcacgggccttacgggcagcctcacgagcctgccgagctttggtggatttgcgaatcagcatttgagcaaattcaccattttccatcaagaagaattgaagttgttcactcacaatattatcaacaatcgttcgtgcttcgggtgtcccgagcttttccttagtttgaccttcaaattgtaagagattttccggtactcgtaatgaaataacagcggataacccttcacggacatcggagccttccaaatttttatccttgtccttcaataggccaaccttgcgagcatattcattgaacgctttcgtccaggcactacggaacccgacttcatgcgtcccaccgtctggcgtccgcacgttattgacgaatgacaacaagttttccgaatagccatcgttgtactgcgcagcaacctcaacttcgacgccttccttagtgccgtcaaagaacataatatccccgagggtgtccttatcttcattgaggtaactgacaaacgccttgataccatcttcgtaatggaagaccagctcttgttgttgattttcccgttcgtcagtcagcgtgattttgacgcctttcagtaagaatgcggattcacgcaaccgttcagccaacgtttgaaaattataaaccgtcgttgtaaagatactagcgtccggcttaaaagtcattgtcgttccagttggcttattagtcttccctttcttttcaagggtaccgacgggatgacccccatctttgaaatgttcaacgtagcggtagccatcacggacgatggttaccgtcaattcggacgacaatgcgttaacgacgctcgcaccgaccccatgcagcccaccagaagtcttataaccaccctggccgaacttaccaccagcatgcaaaaccgtgaggataacttcaggtgttggaataccagaagcatgcattccaactggcatcccacgaccatgatcgacaacggtgatgctgttatcggcgtgaataatcacgttgatttctttaccatagccagctaaggcttcatcaacagcattatcgacaatttcataaactaagtgatggagtccgcggccgtccgtagaaccgatatacattccgggacgtttccgaacggcttctaatccttcaagtacttggattgaagaatcatcatattttgggcttttcttggccattctcacaactccttttatctttaaaaatctacctcaactaggtgcggctttcaggtaaccgtaataaaatagtcctaaaagccccaacctgtcaaggtacaattatgttaatttctaattgtcgcttgtggctcttcatctgttagcatacacgttaacaattaaaatagcaaacacacgttcgcgtttaaaactatcttttaaaaattaagccacttactagcttacctcatgttgattctaagcgccagttcaatgaataaacttattactggtcacgactagttcttaaaatgcgtgattaatttgacagttagcgctttaaaggccctaaccacccgcttttaggcacataataattatcaaaaaatcattttattttcataatttgacacgcaatcatcattttttaaactaattaatccccacaatcttaaaaagaatgctaaaatattgagtgattctattgcaggaggaaccaactttgaaaataataattatgctgatcatcgcctacttaattggcgcgattccttcgggtgtcattattggcaagtttttctttcacactgatattcgtcaagcaggtagcggtaatatcggaactaccaacacgtaccgggtcctaggcccgaccgctgggacaattgtcatggtgatggatattctaaaaggcaccatcgcagcactacaaccgaccttgctatttcatatgaataaccgctataccttattgattggactagcagctattttaggacatacgttctcaatttacattggctttaaaggtggcaaggccgttgccacgagtgctgggatcttattggcctacaactgggagttcttcttaattgctagtgccatcatgttattattggtttacacgaccagtatggtcagtgttgctagtatgacggcttttccaatcgtcactttgattgcaatcttttactatcaggattggttgctatcactcgtggcctttgcattgacgctcttcatcttctatcggcaccgcagtaatattgcccgtatcaaaaacgggaccgaatcattggtacacttcggactcggttggcgacgtcagcaacgtgctaaccacaaataatcgcactcttttcaagaccatttcattattgagtggtctttttatttaggaactggtaagcttagttgctgggcttgtgtggtgtttttgctcttagttaaagtaagatgatacaaatatcttttgtgcctttttaggccacaacaaaaaaccggtcaagcggcttgaccggtttcgtaaattcacactagtttagttagaaaaagctaatcgcatatttagcatcaaacgtctggttcgctgcaagccggttaatgcccatcttatggcttaattgaccgtcgctatcaacgttatccgcaatgccccaccatggctctaagcacacgaacggcgcttctgcggggtatggtgaccacatgccgacgtatggtgcatcttcaatcgtcatcgctaccccatggtcatccagatcagtgtccaacattaacgtcgtctcgtgatggtccaaatccaaaatcagggcatcgtccttaaacaaatcccggctaagtgctaatggcttggttagatcgaaatcatccgcatttgccgcatcgttcaacggcgcctgtaatggaatatgcgtgtagaccttccgtggcgccacggtgaccttataatcagctagtgtgcccgccggatcagcgagtggcacgttaaatgctgggtgccccccaacagaaaacaacagctcttgattagccggattatgcacattgtagttaacggtcaattcatgatccgtcaacgtataaaccagacgtaatcgaaacgcgtatggatacatctcccgcgtcgcgcgactatcggtcaattcaaatgttgcttgtgtggccgtttggttgacgaccgtaaagtcattgtcgcgggcaaaaccgtgttgtcccatgtgataagcctgaccagcaacggtatattgatcatcctttagacgaccaacgattggaaaaagcaccggtgcgtgccggccccaaaaagttttgtcggcctgccacatgtactcgattccgtcgttcgacttgacactacttaattccgccccagcttcattaatcaaaacggtgaggtactcattctttaattcgactgtcatccgcgtaaacgcccccttgataaattttataagatgtaacgactaagatccttatcctgtgcaatgttaccgatccgctcgttgacatagttttcggtgatcgtgacttcgcccatttccatgtcagggccttcgtatagcaattcttccaagagcttttccaaaatggtgtgtaaacgacgggcaccgatattttgcgtctcatggttgaccttataggcaatcgtggcaatcgcttcgatagcctcgatcgtgaacgtcactttgatgttgtccgtgccgatcaaggcgatatactgcttgatcagcgcattcttaggttccgtcaaaatcttaacaaagtcatccttgcttaaatcgtctaattcgacccgaattggaaaacggccttgcaattcagcaatcaaatcactaggtttactttccgcaaaggccccggaagcgataaacagaatgtgatcagtattgatgggaccatattttgttgaaatttgtgacccctcaacgattggcagaatatctcgttgaaccccttcacgtgaaacttcaccggaaccttgctgaccacccttagtaatcttatcaatttcatcgataaaaataatcccggtattttcagcacggacaatcgcatcatgataaatatcagcgttattgactaacttttcggattcttcccggactaaaatttctcgggcctctgagactggcattgtccgttggatccgcttcttgggcattaaagcccctaaactatcaccaagatcaatacccatttgaccaagcatgttattattacccgcggcggcttgttgggggtcatccatctcgatggtaacctctgagttttctaagcgccccgttttcaactgatcggcaactgataatcgttgattacgaacttcatcggtcacttcttcgttacttgaatcgtcaacgttgggggtctggccgttttgcatctggctaaacatgttcatcatgttttggaactcgttaccattattcttagcctgcttcttttgggctggtactaataatttgacgagccgtttatcagcagcctgcaccgcttgcgcccgcacaccagaataagcctgttgtttttccatctcgatagccacgtccactaagtcacgaaccatggattcgacatcgcgaccaacatagccgacttccgtaaacttagttgcttcaaccttcacaaacggggcgtgcacaatcttagccaaccgccgggcaatttcggtcttcccgaccccggttggtccgatcatcagcatatttttgggggtaatttcttcctgcatttcagcagaaagttccatccgccgataacgattacgtagcgcgattgccaccgcttttttagcttggttttgaccaataacataattatcaagcgcggccacaatttgtttcggtgtcttattgatttcttccatgagcgtttcctcctacattacaacgtttctgagatcacattatgattggtaaagatatcaatgtcgccggcaatatggattgccgcttcagcgacttccttggcactcatatccttggcatgtagctgcattgcgcgcgcggcggctagggcaaagttgccaccagaaccaatggctaagacgtcgttatccggcgtgattacttcaccactcccagaaacaagtaacatgtcatctttgttcatgacgatcaacaaagcttccaatttctgtaacgcctggtcactacgccattcctgggcaagctcaacggctgcccgttgtaaattcccagaaaattcgttgagtttcttttcaaaacgatcttcaaggttaaacgcatccgcgacactcccggcaaaacctacgacgacctgatcattataaatccgccgaactttatgggctgtccctttcattacgactttttcacccatcgtgacctgaccatcaccggccatggcgttatggccgttttggcgaacggcgcaaatggtagttgcttcaaatttcgttgtcatgttcagtctcctttgtcgattcccgcgttgcccgtgggaaaaattgacgataatcttgttgtaaatgttcctttgtcacgtgcgcataaatttgcgtcgttgacaaacttgtatgccctaacagctcctgcacggtccgtaaatcggcaccattattcagcatctgcgttgcaaacgtgtgccggagcatgtggggatgaatatcagccgttaaactacttttcttaacgatttgattcaagacatattcgatcccgccgccggtaatgggaccgccatgccgattgataaacaccgtttggtgcgtttgaccatacttggccatcacgggctgccggcagacggtttcgtaatgctgcagtgcggcagctgcgtaccgcccaaacgggacgtagcgttccttgtcgcccttcccacgaatcaacatcatttttaggtcgtagtcaacgtcggctaattgtagatcgacacactcactcagccgaatcccagtaccatacagaacttctaataacgccgcgttccgggcccccatcacgctatcatccgcatagacggtttgaaataacacatccagttccttttgatagaaaaaacggggtaagcgcgccgcgtgctttttgagttgaacgtacacgaagggattcaacttggctaaatcattcttaactaaaaagttatagaacgatcgcaaactcgaaacttttcgagcaattgaattgcgggtcaagtgccggtcatataaatgactcaaatagacgttaacgtccaaccggtcaacttcagtatacgctttcgcgccgccatttgccgttaagaaatcattaaaagcttgaatgtcttctcgataagcagcggcggtctcttccgaatactgtcgttcaacccgaatgtactttaaaaagagggttaaataatccgtttccatgcaaaaacctccatacgttgctactttagcaaagtatggaggaaaacacaattatgcaccctgtcaatggggcgatattttagttgttaacggtcaacgtttcatctttaaaagtcgtcaggtcagccaaggcccgttcagaaatcgccgtattacgttcacgcttatcccgaatgcgctgtttgagttttggcataatgccaaagttggcgttcatcggctggaagttgctagcgctcgtatgcgtgatatagtgggccatcgcccccatcatcgtgtccgttggaaaaacgaccggttctaacccaagtgctaagcgcgccgcgttggttccagcaacgatgccactcgctgcactttcaatatagccttcgacgcccgtcatttggcccgcaaaaaataagtcaggccgttgctgcgtctgataagttggcgttaatagtttcggtgacttcataaaagtattgcgatgcatgacgccataacggacaaattcaacgttctccagacccggaatcagtgaaaagacccgtttttgttcgccccacttaaggtgggtttggaagccgacgatattatatagatcaccagcggcatcatcttggcgcaactgaacgactgcaaagggttgcttacccgtctttggatcttcaaggcccactggtttaagtgggccaaatagcatcgtttggcgcccacgttgtgccatcacttcgattggcatacaaccttcaaagacatccgaattttcaaaatcatgcgcttcggccatttcggcgtgaatcaacgcgtcatagaaaacgtcaaattcggcttccgtcattgggcagttcagataggccgcttcaccgcggtcatagcgtgatttgagatacaccttgtccatgtcgatcgaatctttcgttaaaatcggtgcggccgcatcaaaaaagtgtaagtcatcttcgtcgttaaacgcttgaatcgatttcgctaaggacgccgccgttaatggtccagtcgctacgaccgtaataccatctggaagactcgtaatctcttcattaataatctcaacattaggtaacgcggtgattgcagccgtgatctctgcagagaacgtatcccgatcaacggcgagcgcaccgccagctgggacagcgtggtgttcagccgcttgcatcacgatcgaatccatctgtcgcatttcggcctttaataggcccgccgcgttggctaattggttcgcccgcagtgagttcgtgcacactaattcagcaaattgcgccgtgtgatgggcgggagtcattttgctgggccgcatttcatacagccggacattgacgcccatattagcaatatgccaagcggcctctgagccggctaaaccggcgccaattacgtttactgttggtattgatgccatccagaattcctcttttcttgttgtcataccattgatagtattgttgtcatcatacctgagaaactagcagaagacaactaatggcatcagcaaatcctgcaatgagatggccgccgtcaagcttaaagcgaacattaatttaagtgggcgcttattttaccgatgaaacacttgttaatcagttgaaattacgaattttgtcaacggattttcacaaattgtacgtattgtttgacaatgcacaaaaaaagatcatccgtagatgaccttttttttcatttatttttgaacgttttcggtataatcgccattcggacaaagcacttgcttgccacctttgaccttcttttcgaccaggtaatggccatccttcgggcagtcacgaccaaccggcttatcccaagagacaaagtcacaatctgggaagcgggaacaaccataaaaaatccggttcttcttcgatttccgctcaatgacctggcccttcttacattgcggacaaacgacaccaatttctttaacgatcggcttcgtattacggcaatccgggaaacgggagcaggcaaagaatttgccgtaacgacccatcttcacaaccatgggcgcgccacaaatatcacaattgaagcccgctaattcgtctttgatttggatcttctccatactttcctcagccgtggcaacttctttcgaaaacggcttatagaaactatcgacgactttgacccagttttccttaccttcttcagtcgcatccaactgttcttctaaactggccgtaaagccgacattaacgacatccgggaagtattcctgaataatatcgttaacgatctcgccgagttcagttggcacaaaccggcgcgcttctaatttgacgtagtagcgccgctgaatcgtatccagggttggtgcgtacgttgacggccgccccacaccattttcttccaatgctttgatgaggttggcttcagagtaacgtgcgggtggctgggtgaagtgttgttgtggatccgtcttcgataactggaccacatcaccttcacttaaatcgggtaagacgttattcttttccgtcttatcgtagatcttcgtaaaaccagcaaacttcgtcttcgacccgttcgcccggaattggacgtcattttggtcgatcgtgaccgccattgtatcaagtacttccggcgtcatctgactagccacaaaccgtgaccagatcagctggtataaccggaattgatccttcgtcaaatagtctttgatacttgcgggtgtccggaagacggatgagggccggatggcttcatgggcatcctgagcgccttctggtaacttgcccttgacaggtttggtggccgcgtattctgcgccgtattctttatgcaagaattgtgacgcttcgtgcttcgcaatcgacgagatccgcgtcgagtcagtccgcatataagtgattaagccgacgctaccttccttaccaccaacgttgatgccttcatataattgttgcgctgccatcatggtcttacgcgtccggaaattcaacttccggttggcatcctgttgcatggtggaggttgtaaatggcggcgctgggaaccgtttacgttccttcttgacgactttgacgacattaaaatcgccattccggtctaattggcccaagattttttgcaccgcatcgttgtcatccaacggttgcttcttaccatgggttccataaaaacttgccatgaacttggaacgacccttttgaaattcactatcgatcgtccaatactcttggggcttgaacgctttaatctcattttcacgttgaatgatcaaatctagcgcgatcgattgcacccgaccggccgataagccctttttgacctttttccacaataatgggctaattgagtaacccactagtcggtccaaaattcgccgggcctgttgggcatccaccaggtccatatcaattgaacgcggttctttaaaagcgtttttgaccgtatccttggtgatttcattaaagacgactcggtttttatccttagggtcaagtcctaataaataggataagtgccaagcaatggcttccccttcacggtccgggtcagatgcgaggtacacggctttggcttttttagcctcttttcgcaatcccttgatcacatcacccttaccgcgaatcgagatatagtgcggttcatagtcgttatccacgtcgacacccatcttgctcttcggtaaatcccgaatatggcccagactagcgacgactttataagaacgacctaaatatttttcaatcgtttttgctttagatggtgattccacgatcaccaattttttagcgggtgttttgcttttccgcttggtagcagttttagttgcggtcttccgctttgccgccggtttggctttagttgtacttgcagccactcgatcagctccttacaggtttcattatcattattataaatatcagtttaagaaatccctgtaatcatatttcaaaaatttcgtgttgtcaaatttttggtaaaaactcttctattatatgtcgcgaatttaagactggtttggcccccgcaacgatcaattgattgcacccaactgaaaatggtgcatcaattggtccaggtaccgccagaacgttgcgattgttttgtaacgcgatattagcagtaatcagactcccagaatgggcctgcgcctcgaccacgatgaccgtttggcacagcccggcaataatccggttacgagcaacgaagtggtatggttccggacccacccccagtgggtactcactgattaataaaccgacctgactaatttgttgctgcaggtcacggtgttgacgggggtaactaatatccagtccagtcccgatcaccccgatcgtcggtaagttaaaacgaagggcggtccgatgcgcaaaaccatcggcgcccttcgctaggccactgacaatagtcagcttttccgtggctaacggtgccaataattgtgtcgtgacccgttccgcatacgatgtcgcctgtcgcgcaccaacgaccgcaagttgacgcgtcgtgagtaacgcacgctgtccgcgcaaaaacaacactactggtggttgatagccttctaatagggccggtggataatcatcatccaagatcgttaaaatatcaagcggcgcatgccgttttagtcgttgttgaaacgccgtgctttgccagtcagcggtaaaacgctcctgctgactagcagttaaatgggccaatttacctaattggcggggatcagtgacgaccatgtgaacctgccgacagtgttgtagcacacggaccatcccggcatacccgatgccgtgtgctaagtgtaatcgaatcaataaacttcttaactgcatgttatcacgactccttaagttcgcccttgttgacactagtcgtcaacaaaacggcttctttaaagagtagttacggatttagacccgcttagcatttcgaaccggtgaaaaagattggcgatggatcggcgtggcgcccaaactggccaacccggccaaatgcttagcagtcccgtagcccatattatcagcaaagtcgtacccgggatacacttgatcgtacatggtcattaagtggtcccggacgactttggcgacaatactagccgccgagatgctcgcgctcttcgcatcgcccttgattagacgggtctgttcaattggtaccggcacctgcatcgcgtcaactagtaaacgggttggccgaacggacaggttacggacggcttgggccattgcaactcgggtcgcctcgtagatatttaattgatcaatttgttgggcatccgcaacgccgatgcccacggcgaccgcttcttctaggatccgtggcatcagggccgcccgtttcttagcggttaattgctttgaatcattgacttctagcaaatcaaaatgatcgtccaagactacagcggcagtgacgactggtccagctaacggaccgcgaccaacttcatcaatcccagcaacgtattgtccgccgtgggcccaaaaatcccgttctaaacgcatatgttgattaaaacgtgtctctaacaccgcctgtttttcagcttgtcgcaaatagtgttgataagcctgctgcacgcccttgcgcgggtcggcttgggccgcggctagcagcgctgccgttggttggtcagccagtagccgtttaaaatccgcaatcgttcgttcaggcatcggattgatcccccgttaagtcgagcgtaaaacgaccgagccggcccttgcgaatatctaagaggaaggccacgcagaaacgttcccagtcatcgcgcatccccgcatttttcgtcatcgcaatcagtaattccgggtttggtaaggccaactgctcagccgtcaaatgataacggtcgactaagcgggccgcgtagtgctgcttgaagaagtccaaggcaaacaaagcgacgtcatcgttaggatagatattttccttaatcgcgcccgtgacggccaacttggtcccaacgacttggtcttcaaacttcggccataagatcccgggagtgtctagtaattccaatttattggacgctttgagccactgttggcccttggtaacgcccggacgatcaccgactttggcaatttttttattgacaatatggtttaataaggtcgatttgccaacgttggggataccgacacaaactgcgcggattggccgattagtaatgccacgggccgcaatttttgctaacttgtcagctaacatgtcactagccgcttgcgtcatttgcttaccaatcgtacggctacgtgaatcgaccgcgattgcaacttgaccctggtcttcgtaatacttgacccagtcagctgtcgcttgcggatctgccaggtccttcttggtcataattaagaggtgtggtttttgttgaaccgttttttcaatttctggattccgggaagccactgggatccgggcgtcgaccaattcaaaaacaatatcaactaaatgtaaattgtcctgaatttgatgaatcgccttggccatgtgacctgggtaccattgaatatttgccattacgttgtgctcctttttctcgtggcgtgaatgccttcaaactttgatcattgttaaaattctttaacagcacgggctgtcaagccgaaactgctagttccagtggcgacatgcttaagtgctttgcgccaaccaccactaatgcgcccattcaacgaaatcgttggtcgctatgcctcgcatgagcgaagtcccggacacttgctagtccgggactggcatgatgcagcaatctatattttaccatgtttacaccgaccatgctttgaaaccgaccattgagctgctgcccaatacatcctcacgttaatttagctaaccggaacagtgacaccatgttactggctgctagcttgcggtagctgtcaattagttcgttagtcaaagctcatcgtataaccgtccttagcgttaacgtccaccgatacgatcatacaacagttcacctactacaaatgcaaataagcgcgacgtcacagccttcatcatcaagatggccgcaacatcgcgcttatttgattgtcgtttgatagccgtcagctaattaactgacgtgacttaatcccagaattttgccgcaatcttttgtccctgatcgatcttcgcccactgctgagcctccgtcaactcgttgcctgagtcacacgaagcgaaaccgcattgatgggataaatataactggttcttattcaaaatttgactagcttgcgtcagtaaccgtaacgcgcgatcttcatcatctaaggtgttggtcttactggataacaggcccaagacgacttccacattcggccggtcctcaagtaccttgagcgctgaaagatcaccggcgcggtcatcgtcccattcaaggaagaaacggtcgtagtgttggtcatgcaggaatttcttagcaatcgtattgtaactgccttctgcaaagtgccgactttcataattaccacgacaattatgcgtccaaactttcaaccctaattgatggccaaaatcaactaactcattattggtgttgacggccacatcagctaattcttgaagactgccattgccagcaccaaaggggctttgctgattatcactggcaaacacttcccacaagcagtcatcgaattggatgattttgccacccgcagcttgataatccgttaaaaattctttatacgccccgagtaagcctgcatgcaagtcatcaacagttttgtaaacctggtcagggccatatagcttatcgatgtatccaaactcaacaaaggcgtgtgcaggactccagatcgttaatttaacgtcattatcatcggcttgtgccttaagttgctgataaatatcgataaaatgatgatgcttgcccgaaagtggtgcggtgatttcaatgccaatatctttacgtgtttcaaaatcactgccgtcatgatcgcgaaaattataaccttcatccgcaataaaccgccgaacaccactaaatccccaaataaaatccaaatgccacattgacttcgtatattcgccatccgttagcacatcaatcccatgcgctttttcggtggcaatcaccgtcttcactgccgcggtttcggcagcctggtagcccggcaaagcctcataaaatgggtattgaatatcgtcacgatgttcgatttgattcttataagtgagtaaactagccgggcgtaaaagtgagccgaccaattggaaatgtgtttttgtcataatgtcatcatcctccgtgtctgtctgaatgagtttattataacaatttgattagaaaatagataagactgattgcattgatgatataataggcaacacctataacctaaatgatttattcaatcacaccagctacaatcatgcgttaactagttactgaaaccagaaatttctcaggaggtgcgtctaatgcgtattcaacaattgcgctacttagaaaaaattgccacgacaggctcgatcaacgaggcggccaaacagttatttatcagtcaaccctcattgtcccaagcaatgaaagaactcgaaaaggaatatcaagtacaactgttttatcgtcataaaacggggatcactttgacggatgcgggccgtgaattcattaactattcccgcagcgtcctcgaccaagttaatttgctcaacgaacattttggtcagggaaccgttcgcaagcgtatctttagtgtctctgcgcaacactatgcgtttgtcgtgaacgcctttgtcgaattagtcaaggaaattggtggcgatacctatcagttcacattacgcgagactgaaacggccaacgtgctcaatgacgttcagactttgaaaagcgagctcggcgtcatttatcttaataagttcaatcagaccgtgcttagccgtttgattgctgacaaagacttaagcttcgtaccgctattcgaggctcgcccgcacgttttcgtcggtcgtgataacccattaacgcacaagcaagaactgactttggatgacctacgagactatccctacctctcttatgagcaaggcgatacgagttccttttattttgcagaagaaatcctcagtacgctgcctcataaaaagcatatccgcatcagtgatcgggcaacgatcttcaacttgatggtgggtttaaacggctatacgatcagttcaggcatcatcagcagtgaactcaatgacgaaaaaattgtggcgattccactaaaagtggatgatgcaatgacccttggatacctgcgccataaaaaaatcgaattgagcgctacggcccagcgctatttgacactgttgaaacaacacattcaaggatatggctttgacgtttttaatgataattgactgattgacacatgccgtgactgaattcattttttgttaacaacagcatcagtggcggggtgtttctggcaattttgatcaagaccgtggtgtccaaacgcaatcgccttcactaaagcaagacacctaaaccgtttaaacattatatatatcattttcaaaacccctgctgagttgtagactaactcagcagggggctttagttttttatcttaatgtattgattaggcctccacccactcaagattcaatcaatcttgttcataataatatgcatttaaagtatatgttttaatcggggtaatctgtaattcatatttttcaactaaatcagctaagtcctgaccatcaatgagtgttaccgtattatttccctgcatcgccttaactttatcgatttcaggctcggatacctggtcctccgtataccgtttacactgaattgccacccggctagtacgaaactcgtcggatttaaaataaccaaagccatcgataccgtgatcagctgaacgtaccaccccacgatttttatcaatggtcacacccatttttgaaatcaatgctcgcgaaaagttttcaaactttccaggattgaatttttttaaacattcaattaaatcactcttccattgtgattcatctgcatcttgttgcgactctggatcatcgattacgaccagattctcatccctatctgccaacttgtcatcagattcctgcatagctgttaatctccgatgtactctttcacgtgtcttctgattccaatagttcgtaactagttgggtttgttcagaggtcggataatgcgataatgacacagttctgccgatacttgtcagtgaaatctcctttccccattccatggaactaatataaccaactgtatgtagattttttaacccaaagttgaaatcatataggaagggattatacgctcttccggtccgtgcactgactttagtatcatagacatcctcatacctcagattagcatattcatttgcagcaattgtctgacgtattatttttcgtgaggctgttccaccaagttcccgtagtgctaaaacgattgccttctctacattccaacgcttataactcatctcaaatgccaactttcaaatttaatgccaagtattttttgacacaggaaactgtcaatattcggcttcaaaatttattctatcatgtttgaattagtcttgcgttgtgcattgccccatccacccactaagatcacgaaaaaatacgacattcaggttgaatgccgcattttagtttggtttaactactcgtttgtttcagcatccaatgcatgtttggccgcaagtgcacgaccaaaatcagtttcatcaaaatgatcaatgatttgctgaagcgcggtcgcacttaaactggccccaaataacggactgccaggctcagtcataataccatccgccagtcggggatagctaatgggatcaaacccaagcgtctccacaaagtgggccacagttgctacggcttggggttcatcaccagctaccaatagggccttccgcgccggatcaccattaggtctggcgtcttcttgcagattatgataacccatatggttcagtgttttaaccagatggctccctttgaagtattgctggacttgttcgctggaggacgtctggggatccagaacttcttcccgtaccccgtctgtttcccaccaataattcatagcgtcaattacaagtttgccatcaagcgccgtagccgggatttgccggtaacgactcagcggcaatgctaaaataattaactcactgttggcgatgacatcctgattttccgacgcaattgcacccggaactagtgtttgaatcgttagttcaattttgcttactttgccagagcccgaaatgcgaacgtcatacccggccgccaatgccagttccgctaagacgataccaactttaccggcgccgaggattccaacgtttttgactgtcatttggtcgtcacctgcttcgcttgtaaaatagttttaacttgtggaatcacctgtgtcgcatacaattcaatcatccgttcacgttgagccgccgtttgattaccggccccgtataccaagtcaaagcgccccagccccagtgtttcaatcgtcgtcgcaatccgttgcgcaaccacggtcggcgtcccaacataaaacgacccgtattttgtttcacggtcaaattgttcgtgactcattggcgcccatccccgggtcaatccaatgcgatcaaaattagctttgatattttgataagccactgccaaggcctcatcctgatcatccgcaatgaatccatgcgaatgcaccgcaatcggataagctggctgattgaactttttagcggcttcgtgatacagtttgatatacggtttaaatcggtccgcccgaccaccgatgattgcaatgatgactttatagccaatcttagccgcgcgaataattgattctggtgaaccaccaatcccaatgtaagtctcaagtttaccagtagctgtctttggatacacgtcttgattcgttaacgaagcccgaaacttacccgaccaagtcaccggcttttccgttcgcaattggtcatatagtgcgagtttttcgttaaataggtcatcataatccgtcaaatcatagccaaataacgggaacgattcggtaaacgacccccgtcctaacatcacttgggcgcgcccattagacagaccgtctaacgttgcaaaccgttcataaactcgaaccgggtcatcggaactcagcaccgttactgctgacgctaatttgacgtgctgggtcacggcagcggtggctgctaacaccgtttccggacttgagacactgtagtctggtcggtgatgttcaccaatgccaaaaacatccagcccatactgatccgctaactgaccttcgcgcacgatttggcgcaatgactctcccgccgactgtaaactaccatccgtgttcgccacaatatccccaaatgtttctaacccaaattctagttgattaacatcaatcatcttaatgcccccattacttttgttttgcttacttttagtaagtaattgatgttaatatatcgtattatctctttaaatgcaactgataggcacagcttgacagtcaccttcaatcatgattaaaacaatctgccaattggatgaattccggttcggtagtaattcagcgatacaagcatcgcacagaataaaaagaggtattcaattagaatacctctccgtaagttgttccgaaccaatcatcattgcaaaaatcaagtttgcacaggctatctagctctgggcctgccgttgcgtctcatgacgttgtgcccataagttgatcactaaagcgacgatcattaatccgaacgcaacaatcatgatattttgtagtccagtgtgtaagatgccacgcatcatcggcactaggtgcgctggtagccggcccgcccgactagcatcacttaactggttcatcatcgccatggtgattttaccatccgattgtgccaccccactagtcaaagcttggttcatgattagcccaaagatagccgtggtaaacgtctggctgagcatccgaatcaaataactaaacgaagtcgcaactggaatgtcacgttgatcagcgtctacttggaccttaacctgcagctcattaaagcaggccccgttgccccaaccttcaaagaagccagctaagagtaagacccagtatggaagcttaacaccgccaaacatcaatggaacgaaggtcagcgtcaaaatgataatgttgatcgtcaagacgcgatggggtgtcaagtgccgccgcatgcggggaactgattcactgcctccgaaattagcaaaagcacttggaatctgcgtggcgcccccaattaacgctgacgtccctagcaagccctgagcccacatcggactgtacgtcaaaaaggcaacgaacgcgccccaaataagcacaaacaagacgaaatcgaccactaacggcgcgttcttaaacaggcggcccggaataaccgggtccacagcgcgccgttccacgatggttaaactgcccaatacaatgagcgcccccacgatcacgatcgcgacaatccataacgacaccatgccgatcagttcaataccaccaagcaaactgatgattccaaccgccatcaataacgccccggcacgatccattggttgcaagttatgttcccgcttaggttcttgatagaagatttgtaacagcacggctgagacaatcccaattggtacgttgaggtaaaagatccagtgccaagaccacacatcgacaatcacaccaccgaccatggggccaataatcgttgccatactaaagcaagccgagactagtcccagtgcccgcattcgatcacgcggattcttaaaaatatccgcatacatgatgtaaggtaaggaaatcatccccccgttgccgagacccgcaataccccgagcaataatcaaaaaccagatgttgggtgctaatccttgtagtaaggagccgacaataaagagtgccgtcgtcatttgataagcgcgcttattaccaaagcgctcacccatttttgaccagatcaaggtcgaaacggccgttcctagtaagaaaacagcgacgatccacgccattaaccgtagaccgtgtaaatctgcaataatggctggtagcgccgtattcacattcgtactatcgataccagccataacgttcgatagtaacagggcgccctgaacaaaataaatggcccgtcgattcacaacaaaacttctttctatctataattgctaaacatctcgtcagtcgttcagctaaaagttacctcaatccaacccgttgaaattcactatttcataccgatcaattaacgcacaatttctagtataccgctttacccccactgcaaggcaagtctaaatcttgatttcagttcatcaagaataggacttcccactgtcgatgtatgaagcacgcgtgaccagccatttctgagcctttttcgtaggtgcacctccatcttgtcaaagcttcgttgccggtgccgcattaaaattccgcaactaaaaaggtgtgaccgaaagccatgcggatttcggtcacaccttttaaaatatacgaatcagctttgaactaattcgtcttttcaatcaacttcattgctgcatcgtaagcctgatcattatcactgatcttattagctaattcagtctcgatcttagtcagggtctgtttatcgaccttgccattgaccgttaacttggcatgcttttgatactgcttgaccgcactggtggttgaatcaccaaagtagccattaacagtccctttaaagtaacctaaggcttgcaagtacttctggaacgtcttgacattgctattgaccttgtcagcttgtaagtcactgaccttgctaataaccgtcaaacttgcataactcggctcatcagctttaacatccggtgtcaagcccttcttgttgatccaagtaccatttggtgtcaaccactttgcgaccgtgatcttcatctcagtcttatcattaaaagtcgtcaccgtttgaacggtccctttaccatacgactgggacccgaccagtttaacacctgccgattgatgcaaggctgcggagaagatttcagctgccgaagcactcccaccatcaattaagacggtcgttggcttcgtttctttaaagccaccatcatacttcttggacgccgtgtatttttcggtcgaaccatcgcgtgcttggacctgcataatcgtcttaccattcttcaagaagattgaggccatcttcaaggcagccgtcatcaacccgcccggattaccacgcatatcgatgactaacttcttggcccccttcttatcgagtgccttcaacgccgtcttaaattccttagccgtattcgtcgagaaggtcgataccgtaatataaccgatcttcttatcgccaccgactaacttataatcaacggtcgtcactggaatcttagcccgcttcaaacttacggtaaaggtttgaccactgcgctcaatcgtcaatttgaccgtcgtcccgatcttaccacgcatcatgctaacggcttgtgtcaaggtcttaccggccactgacttgccattgaccgccttaataatgtccttcggtttcaaaccagctttcttagctggcgtaccagcaattggtgaaataatttgaacatagttgccagatttttgaacctgggcgccaattccagaaaacgagctgtcgatcgtgtcattcaagctttctgtctcgctcttgtccatgtactcggaaaatttatcacctaacgaattgaccatgccgttaatggcaccgttggccaacttattcgcattgaccggtttgtagtaattctcattgatcgtttcataaactgattcgatctttttcatcgctttactagtctgttgcatactgctgagctgggcattgacttgccgaccgatcagccagtacgtcccaccaaccccaatgcctaatgcgacgacaattgaaataatataggtccatagaccaacgcgtcgcttgggccggggcactttttttatgtgcggattagtttgtttgggttcctctggcataccgaacgtcctctttcctacaaattaatttaagcttcacttgccaaataggcttgccacgcgtcatcaaagaccgtcatcgttggcaaataaccagcgttcaattccaaatattgtgagagttcatgaaaatctttactctgctttggaaacgattgatccaaaaacgcattattggcaaattcggcaatggcatcggtactgtctgggttccgttgcgtcatcaaaaatgtataaaatgttttatgcatgaattcactccttagtcactagtttttggaatatgcatttcgaacttgaactgattattcttcaaatcaagcttatctacactataacgaacatcatgtttaccaactaatttattcaagtagaggtcgattgtcttcttcttggcattcagcttgacccacttaggtgtcttgtaattattattaatataattaatcacaaagctgattggcaaggacatcgtcccgaccgataagttggttgctttcaacgaaatattgccgttatcgatgacactaggtttcatcgtaatcacaaacgacacgttttgccccagtacctgggtcgttccgagcaaataagcgccggtagaccggaccacaaagcgatatttcatgtcttggcccttttgtagatcattcaaataataactcgcaagggcgtttaattgttttcgattcattgtaatcggcacactagccgcgtccgtattgctggcagtcgtcaaactggtactttcactaggcgaccgtaagacctgggtgccgacgtaagcaccggtaccaacgatcaacgcaatcaagacaacggcgacccatttccaaacattgattgggccgtttgtcttcggctttttaggtgctggtgcctgcttgtttcgttgtgcttcccgcatctcattacctccctattttttgatcaaccacgcatcatggaccatcatggtctgatacagtttggttgtaaacacacgatacccctgcttattgggatggaaattatcagcagtcgaaatcaaatcattcgtcttgttttccgtctctaacgcaccggtaatggcctttgagctggttaagctagttaaggtcgtggcactcgctgctttcttcaacttacgaatctgcgccgccgtcttgtactggccgtgcgacatcgtccaattgatatccacaaagtaggtgtgcttgtattgactaaccgtcgtctgtgtctgatcattccactggctaatgtagtgcgtgatcgacgtcacatttggaaagttcacataaattggattatagatgctaaagacaaaaactgacgcagtgccattcaaactttgtaatttattaaataatttggttagtttattcgcatataaagtttgcgctttagcaaccgtcgcgttatttttggccgtattgttagaagttagggacccttcgagcgtttgcaggaggtcgttaccgccaaccgtcacggtaatcacatccgccttggcaattttctgttgtaacgctttcgacttattgatgcgtgctaaaatctggtcactccgatcaccggacttgccagcattcgtggtcgtcaccttcagcttttgcttagtcgtcaacgttttttggatttgaccaacgtagccaccctccgactcatcgccgaccccttccgttaaggagtcaccgaccgcgaccaagttgatctgcgccttatggggcgtcttcttagcagtagtctttttagtcgttgttgggggcgtcgacgccgattcattttgcggatgcagcaaatagttgaccccgaaaaatacaccgaccgctaacaccgccaccactaaaatgattttgatggtttctttaactttggacattggcatccaacctttcttcaccgttgagcagtccatctaatcagcgctaactcatcttggaacaataaaatggtcaccatcccctgttgggacgatcaccatttgccattagtgctcgtagacaagccgcctgtgggacaccgctcactttacgctggcacttgcgtatgatattccacggcaaacgcacccgggccaccatgggtcgcaataattggcaccgttggttgaacactgaccttgagacttggtaaagccgcttgtaggcgtgcccgatattcttccacacgctccgtggcgccaacatgagagatcgcaacttcggcgacgttcggcgttgcgataatatcgtcgagaaccttatcaaaaaatttattaatcgccttaacaccgcgccccttcatcttcacatccagggtgccgtcatcaacttccaaggcaatcttaacattcagcaacgtactgatagctcccgtcagccggctgattcgaccaccagcaacgaggttattcagggtcatgacgcccataaatagcttggtatgggcctgagttgcatgaatctgatcaatgactgcttgtttgtcagcaccactctgggctaacttagcagcagtcaaaacttgaaaggccatcgcacgatcggtcgtccgcgcgtcaatcacggtgacatcggtcttcgtaatcgaagccgcttgttccgccgtgtgcaccgttcctgaaatggcttcgagcatattgatacaaatcacactcgcgccatccgcacctaacttatcaaacgtttcaatgaacgttccgagtgccggttggctcgtctttggtaaagatttagccgttgccatcttgtcaataaattcttcacgcgtaatcgtttcatcttccacgtaaatggtgccatcgatcatgacagtcaacggaatcacggtaatatcgtatttttttacctcggcatccgtcaaatttgccgaagaatcggtcacaatcttgattttcgtcatactttgccacgctttcttatacttgtaacggttaaacgatcgttacaataaaattaatgctttcagtatagcagaaatctgcctgagtttcacggttgccgctgaattaacgccggcggaaatcatcaaattcgtacggatattgatttttctcatccaccgttccaacttgttggctcaccagctgccactgcgtgtaatccacggctggcatccaggtatcaccatcaaaccttgcgttgatacgcgtccgatataaataatcggccaccggtaacacggctgcaaacaccaccgcaccaccaatgacaaaaatcggttcatccggatgggcggccgccagtgtttggatcgccgccacatctgctagttggtggacttccggtggcaacttcaaatcaggctgacgtgagagcacccagttggtccgccgggggagcgggcgtttaaaacccgcgaaggtcttgcgccccatcacaacatggtgtccggtcgtcagcgccttgaaccgctgcatatctgcaggtaaatgccagggaagctggccctggttgccaatcaggccattttgatcttctgcccatatcagtgcaatcattgcggcctcctaaatcgcgaccggcgctttgattgccggtgcgggatcatagccactgagcttaatgtcactcatttggtaatcaaaaatactgtcatgcgccccacttaaagtcagctggggtgctggccggggttgccggctcaactgcgttttaacttgctccacgtggttcgtataaatgtgtgcatcacccaacgtatgcacgaactcgcccacggctaggcccgtctccttagcaatcagatgggtcagtaacgcgtaactcgcaatattgaatggcacacctaggaaaacatcgcctgaacgttggtagagttggcaagagagcttaccatccgcgacatagaattgaaacagggtgtgacacggtggtaacgccatgttcggcacatcttctggattccaagcggaaacgatcaaccgccgcgaatccggatgcgtcttgatcatttcaatcacattggcaatttgatcgatcgtctttccctgacgcgtttgccagtgacgccattgcgcaccgtaaacgtcacccaaattaccatacttagccgcaaacgcgtcgtcggccaagatctgctcatcaaaggtctgcatctgcgcttgataaatcggtgcgaagtcgggatcatctagccggcgatgttcaaaattcgtcatgtcagggccgtcgtaatcggcactcgtgacccaatttttgaacgcccattcgtcccagatatggttgtgatgttgcaataaatactgaatattcgtatcaccatgcaaaaaccatagtaattcgctcttgatcagtccaaacggcacttttttggtcgtcaataacgggaagccctggctcaggtcaaagcgcatctggtaaccaaacacactgtatgttcccgtgccggtacggtcatccttatacgtgccgtgttctaaaatggtgcgcgcgagttgtaaataactatcttctaacatgcgatcatcctttcaggcttctgcatactggctgaggtagtcccagcgatccatcttctcatcaatcgtttgttccgtcttagtcaattctttttgcaagtcagctaacttaccataatcactggcattggcagccatcgccgcttcgatctcactcttatggctatccaattgctcgataaccccttcgatcttgtcatattcgagctgttccgcgtaagtcaacttgaccttggctttcttggccactggtgcggtcgagtcatccgtgaccggcttcgcagtagtttttgtcgcactggccttggctgcgggcttggccgcgtctttttgatccttcaaataactggagaaacggccagaatagcgttcaatatgcccctgaccatcaaaaatcagcagtttcgtgccgaccttgtccaaaaaatagcggtcatgggaaacggtgatgacggtcccggcaaaatcatcgaggtagttctccagcaccgttaacgtaccaatatccaaatcattagtcggttcgtccaataagaggacgttcggctgttgcatcaacaacttcagtaagtataaccggcgctgttcgcccccagataacttgcgaatcagcgtgccgtgcatcgaccggggaaacaggaattcttctagtaactcagtcactgaaacatgctcgccctgcttattcaagaccgtctcaccgacatcttgcaagtaattaatgatgcgtttgtcgcccggaatcggttcggtctgttgcgtataataggccatcttgacggtctcaccgatcgtcacggtcccactatcaagtggtagtcgacccgcaatcacattcaataaactagatttcccggcaccgttgattccagtgataccgatgcggtcattggcttggatcaacatcgaaaagtgatccaggatggtttgccgatcaaactgcaagctcgcgtcctttaactcgattactttcttacccaaacgctgctgaccgagcgaaatatcaacatcgttatcaacttggagcgtattcaaattatccttcaaatcattgaaccgattgatgcgcccctgttgcttcgtgctacgcgcgggtgctcccgcacgcatccaagccagttcctttttgtacagttgctgttgcttgtgttcagctaacacgtcacgggcgacccgttcagctttcgcttgcacgaaatcttggtaattccccgtatatttatgcagctcgccgaatgacaattcaaacatttggttggcgacttggtccaagaaataccggtcatgggtcacgacaatcaacgcgcccttataactagctaaatagctttctaaccactcgattgagtcaaaatcaagatggttggtcggttcgtctagtaataaaagatccggtgattgaatcaacacttgcgccaggcccacccgcttctgttggccccctgacatctgactgacagtctgcgtcaagtcggtgatgtgtaattgtgtcaaaatcgttttgacatcactttcagccgtccaagcatcctcttggttcattcgatcctcggcggccacgtaggctttttgagtcgcttggtcttcgggatgatcagcgtaagcagccaacgtttgctcgtagtggcgaatcgttcgaaagacttgctgactaccggccaacacggcatcaatgaccgtcagattctgatcaagctccggcttttgctttaaataaccaatcgtataatttttgggcatcaccagttgaccggcttccggcgccgtaatcccggctaatacgtctaataaattcgttttcccggacccgttaacgccaatgacaccaatccggtcatgttcattcacaataaatgaaatatcgtgaaataacgtcttctcaccataagttcgggtcagattttctgctcttaaagtttgcattgttacgatccaccctttttttacatcattaagttctatcttagctagaatcggcttaaaacacaactgacaaacgcgcaaatcaacgttaatatttcctaacgaccatcgattacgattgggcgcgagtcacaaaaaaactcctaaggcccgatcggccccaagagtttttggcaacatcttaattattgtgatcaccgtaaacatcaaagacggtccgttcatcatcaacgactaagtgtaattttccatcactagctaatgaactcgtctggtaaatgttgtcgataccatccgcatcccgcggcttgaatggcaagtagatttgttcactaccgcgttcgtcaccaaacaggatgtcaattttttcaatatcttgataatgcgttacccgttcaaacatcccacttgtcacggatgataactgggtcgtatctgggtcaatcgcatcggcgtcaggtttaaattcagccttgaatgatttgcaagggtgaatgatggtcatgtgaccacctttaattcggccataactcgtcgttacccggccaatccacaggtcagagatatcttgatgatgaactgtccaagtgtcaccattccgaaaatgaaatttcaatgcttctaatgctcgttccatttaaatcacctcattgaattagtttcactttaatcgtaacagattcatagaaaatatcaatggttttttgaatccgctaccatccttgcaaaatcaagcaaagcatcctgttgatttgggacctgtttcatcaccacggcctgcaagcaagccgcgagaatttggcccatcattggcccaggcgtcaccagttttgccttcaataaatcgccaccgttaatggccaattcatgcttgtcatgaattggtaagctagcataagcttgcgccaattgtgcttggtcctgaccaaagcctaaaatcgtcgccacctgattggccgttcttagtgcgtctaagcccgtgtaaaagttctcttgcgcagttagctgaccattgtgcttcaatgctgtcagcgccttaacagcggccgtcacatgactgatcagttcattgctcgtcttccacgtctttagtaactggcgaattgctgcttcgtcagtccggtgcatggcccaactgagcaaagtccaggtactctcaatactcggcaaatgccaagccggcagtgccattaactgctgcagcatcgcttcttgatcggccatggcgggcatataccgatacaagccagtggtcagcaagccggtcaaaccggcaactgggtgctgacccatcagcagcttctcccactcaacacgcgtccgttccacggcgattttcgtcaacaacgccgcgttatccgcaattgcctgttcggtctgtgattcaatggtaaagcctaactggctggcaaaccgaacggcccgcatcattcgcaacgcatcttcatgaaagcgttcttcagcaacgccaacggcacgcaagacgccgcgctgcatgtctgctaatccgtcaaacagatcgatcacttcaccgttagcagtcatggctaaggcgttgattgtgaaatcccggcgcttcaggtcctctttcagtgaccgaacgaacgtgacctgatcagggcgccgaaaatcttggtaaccagattcagtccgaaacgtcgtcgtttcataaccattgccgtgatctaaaatcatcaccgtcccgtgctcgattcccgtatcaaccgttcgtttgaataattgtttgacttcagccggaaacgcgctggtcgcaatatcgacgtcatgtaggggcttgcccaaaatcgtatcgcgaacacacccaccaacaaagtacgcctcatagccggccgcttcgatcgtcttaataatcggcttagctgcttgaaactcagctggcaactgcgtcaaaatcatagtaagtgctccaaaccaacaaagagttcgtgatactggttaactttttcaaccgccactttgacacccgtcataaatgagatccggtcaaaggaatcttggcgaatcgttaacccttcaccaggaccgccaaacatgacttcttcgtgcgccactagtccaggcaaccgaaccgcgtgaatccgcatcccttcatattcggcaccgcgtgcgcctggtaaggtttcagtggcgtcaggattgccttgttcctttggttgccgaacttcagcaatcttcttagccgtactgatagcagtcccacttggcgagtcaatcttatcgtcatgatgcatctcgataatttcaacgtctgggaagtacttcgctgcttgttgggcaaattgcatgagcaagacggcactgatcccaaagttaggcgcaatgaggccgcccacttgcttgtccttcgctaatttttgcaactcggcaacttgttcatcggtcatcccagtagtcccaataacgggcgaaataccatggttaagtgcaaactttgcattttcataaacggcggttggaatcgtaaagtcgatccagaccgtggcatccgtcttaatttggtctaaatcatgaaaagctggcacgtcttgacccttaaagcggtcgtcctcacctagattttgttctccactgcgcgcgtcatagaccccaaccaattcaaaatcaggattatcaatgaccatctgagcggccgtactacccatccgacccttatagccggcaacaattacttttaccacaataaattcctcctcaagattaagctaattatattttagcagacaatgaccaaattaggcaggagaatcctcggcaaacatccttaaacttctgcgttgcgcgcttaaattgtcaaatcagcccgtgatggttcgcgtagcgcgactaacacgggctggtgtaacgccgatttacggttccgttcggcagctcgtgtccgcccaatttgtgcatagaagacttaaaaagcagtgtttgactcaacgcggtggtcccgctcggtcaaacactgctaactacgatttcattcggtaatgatcactgacgacgctagattaacgtgtcaatggttgcgaggaccccatcatgattattgtcatgggacgtcagatacgtggccatctctttgacgggggcaatcgcattttgcatcgcaaagctgtaatcagcttctcgaagcatttcaagatcattgccattatccccaaacgcagccgtctgactcgcagcgatatgccaatgctgttgcaaataagcaagcccagtcgccttattaacatggggcggaatgacgtcgagcccattcccaccactgacagtcgcacgtaaccggccagcaaattgctggttgatcaaagcggcgtgcgcgtcagcatccgtatcttgccaactaaaagtggctttatagatatggtcgtcaatggtcaacaatgatggcacgatctgcagtcggctcaggtagtaacgcatgattggactgtcatcttgaggccggatgtatgccccttgcttaccggagatcgagatctcagcacccgccagtgccggttcagtcgccacgtaattcaatagttcctgataaagcgctggcgcaatcaagctttcagccaacacgataccgtgattatcaatgaccaacccgccattttcagccacataggtcaattcaccactgatcccgtcaaaaacgtcaatgcaatgttgcagctgattgccgctcgccacgacaaagtgctgaccctgcgcgttcattttgtccaactgggcttggaaccggttgtggtcaaactgatggtcgtctctcaaaaacgtgccatccaaatcggtggcaataatagctactttcacgatagtaaacgcctcacttgaatttgatatacgttcattttaccaaagatgaaagtgttttcaatagctttagaaatggaactttcagcaagctgtagagaaccaccgtcctagtaaccctgatcctcgtagtcttctagcatcgcgaccatttcaccatcatccggttcgatcgttaaataattccgtaatgctgctacggcactgtcagccattccggcttcacggaagaaataaatcgccggtttgaggaagtccttgttatgttcaaagaacggataagccgcttcataattatccttagctgcctgaaaatgatcaagatgatcattagaaatcgccaggttccagtagaactgtgggtcgaattcattactttgcaagtattgatccaacaagtcgatattgtcttggtaacgttcctgctgaactaataaattggaaagttccaataccgtggtcaagttatcagggtcaatgctcaatccttcccgcaaatacttttcagctaattcctgatcgtctaatttcaaggctaagcgggccgtttgcaagtacagctgctcattgtactggtcgaccgctaaaccttcttgtaaggtcaataacgccttgtccagttgatgaagttgttcttgggcctgggccaagtatggatacagggacgcatactgatcatcttgctcccgcagcttgtcgaagatgtcaatggccttctggagttcgtttaattgcaaataggtaaaccctaactcaaactggctgtccggcgtgagcttggcaggcttgatctgttccaaataacccaccgcctgttcgaagcgtcccgactccgcataagcgacccctagccgttcaactagattaactttggagatttcgagttgcccctgcttaatcaagtccaagtagaaacgggtcgcctgactgtaattacgaatcaggaagtaaaattcggcgagtgcgaattcaacgaccggttcgtctggtgccaactgataggcttctttgagcttctgttcactgacttcaaatagttcctgggtctggtataaatcagcttcaactagcaaagcttgaacataagccggcgagtctggcttaacttgttgtaaatagtcgagcgcgaggtcggtatcgtcctcatcgatcgcgatatcagccaggctggtccgtaaatcgtcctcatggggatacttagccagtaacttcttataagtccgttccgcttgatttaagaaacccaggccgtacagttcttcagccaaactatacagcgtctggtcatcgtctttacgtaaggcccatgcaaagtgctttttggccgtgtcaatttgcccgtttgatagtgctgcgagcattttttctgaataactcattacacccatcctttaacccactaagaacgactgcgtttagtcgccgtggttcatcatttatttcagtaatcagcccgataccgccactcacgataccagctgtaggtcgtttgacctgacagtctatcataccgcagacgacagcaaaaaagccagtataacggtcgctatactgactttcatgtttgcatttcattaactgatatgcattatttaactgcgtcctttaaagctttccctggcttaaatgcaggtactttgcttgcaggaatttggatttcgtcaccagtttgtgggttacggcccttacgagcagcacgttcacgtacttcaaagttaccaaatccaatcagttgaactttttcaccctttgcaagagtgtcttggattgatgcaaagactgcgtcaactgcagcagttgcgtctttcttcgttaagttagttgccgcagcaacgttgttaactaattcagctttgtttgccatgtttgattcacctccccgttacagagtgaaggatcgccgtgctttttaacatcgatgatccagatgatcatttttgagtggtccaaaaatgagagaaacgataacaagcatcatttcttcatcaaagatagcataggaatgctgtaatagcaagcttttttagccttttcagcgaaaatagcgcaaaaagatgataatcgtttacatcaatcaaagaatgtgctaaaatgctgattttacgcgcttttgactacttacgacgccgctcgatcatgtggatcggtgtcccgctaaaatcaaaggcgttgcgaatttgattttcaaggaaccgttcgtatgaaaagtgcatcatatcagggtcgttcacgaagaccacgaaggttgggggttgaatcgccacctgagtggcatagtagacccgtagccgctttccattgtcactcggggtcggattcatcgcaatcgcatccatgataacgtcatttaagacggacgactgaatccgccgcatatggttcgtattgactttcttgatgagcgctggcaattgctccaagcgctggttcgtcttagcagagacgaagataatcggcgcgtagctcaagtaaacgaactgatcacgaatatacgcttcgaattcttgcatcgtgtggttatccttcttaaccagatcccacttattgaccacgatgataatacccttacccgcttcatgcgcataaccagcaacccgcttatcctgctcacgaatgccttcttcaccattgataacaaagagggccacgtcactattatcgattgccttgagcgcacgcataacgctgtaacgctcagtattttcgtagaccttgccttttttacgaataccggccgtatcgaccatcacgaaccggtcaccatcctgatcagtaaacttcgtatcgatggcatcccgggtcgtcccggccacgtcagaaacaatgacccggtcttcgcccagcaaggcgttgacaattgatgacttacccacgttcgggcgaccaatcaaactgaaccgaatcgtccccggttcgtcttccccacttttttcagggaagtttttaatgaccgcgtcaagtaagtccccaagaccgagcccgtgcgcacctgagataggatacggatcaccaaagcccagggaataaaagtcataaacttcactccgaagctcaggattatcgaccttattgacacccagcacgaccggcttgttcgaccgatacaaaatctgggcaacgtgttcatcagcgtccgtgacgccttctttgatgcttactaaataaataataacgtcagcttcgtcgatcgcaatttcagcttgctgcgtaatctgcttaatgaacggggcatcttcaatatcgattccacctgtatcaatcaggctaaattcttgaccaagccattcgccgttggcgtaaatccggtcacgggtcacacctggtgtatcttcaacaattgaaatccgatcaccagcaatccggttaaagatcgtggatttaccaacgtttggtcgcccaacaatggcgacaactggttttgccatattaactcctcctttgccctcgcagctgtcaggttcccgccacgagtctcagattaattggtagcaccaactaatctgttcctaaaaaaatatccttcaaggcaagcttgaagggtatttttaatcaatcaatgattagttttcatcattgttgctttcagcattcttcaattcgtcaccgatcaaatcacctaaagtgaaaccagttgattcttcaggagcgttagccgttgaacgttcgctagcagtccggttgtcccggttgttgttacgacgacggttgttgctccgacgttctggttgactttcgttatcatcgtcagcagtttgtggcttttcttccaaagctttaattgataaagctaaccgcttttcgtctggacgaacgtctaagactttgactttgatttcttgaccaacttttaagacatcgtttggtgtggcaatgtgttgatgtgagatttgtgaaatgtgaactaacccttcaacaccagggaagacttccacaaaggcaccaaaactcgtcaaacgcttaactttaccatcaagtacagccccttgtggtgctttttcttcaataccatcccaaggttctggtaaggttgctttgattgataatgaaacccgttcgcggtcagcatcaacggataaaatcttaaccttgacttcttgaccaaccttcaatacatcagcaggcttttcaacccgttcgtatgagatttctgaaacatggaccaaaccatcaatcccaccgaggtcaacaaaggcaccgaagttcgtcaaacgcgcaactttaccttcaacgacgtcaccagcttgtaaggtcttcaaagcttcttcacgttgtgcttcacgttgcttttcaacaacggcacggtgtgataagatcaagcggttttcgctaggttcaatttcaataatcttaagttcaagttcttggcctttgtaggcatttaaatcttcaacgtaatgatcatcaatcattgaggcagggatgaagccacgaacaccagcgtcaacgactaacccgcccttaacaacttgcgttaccggagctttaatcgtatgacctgcttcgtattctttttcaacatcgtcccaaactttgcgagcttctaaccgacgatgtgacagtaagtaactgccgttttccttgtcgctgccaatccgagaaatgacaaccaagtctaagacatcaccgactttagcggcttcgttgacatcgtcaacccgttgtgttgagagttccttcaaaggaacgaccccttcaacaccggtaccttggataccaacaattacttgtttgtcgtcgtcaattgctaagacttcacccttaacaacgtcaccgacgtttacttcttcaacgctgtttaaagcgtctaaaagttcatttttctcttggctgttttcgttttcactcatgcaaatttcctcctgtcaacaataactctaacctatatcatagctgaaaatgcaatgaaaagctagctaaaagcattaagttaatgcaattagattgttgaactttgtttttttgtaataatttcggcaatggcagcaacaacttcgtcgattgacattggcgtcgtatcaacaagtgtggcgtccgctgcctgtgttaatggtgacactttccgcgttgagtctttgtgatcgcgtaattcgatctcagcctggagctgagccaggggcgtgtcaatcccctttttaatattttcggcatagcggcgcttggcccgttcagccgccgaagcaactaagaagatcttaacttcggcatttggcaataccgttgttccgatatcacgaccgtccatcacgattccaccggcattggccatttcacgttgttgctcagttaaaatggtacgaacttgtggtagcgctgcaatcgtcgaaacgttattcgtcacgtctggttggcgaattgccgccgtaatatcttcctggttggcaaaaaccagttgatctggttcgccgggcttaaaactaatcttgagcgacttcatcgccgcaattacggccggttcatccgctaaatcaatgtgctgttgcattgcccagtatgtgaccgcccgatacatggcgccggtatcaacataaatatagccaaaccgttttgcaacgagtttggctacggtactcttgccagctgaagccggaccatcgatggccacctgtaatgcttgcttagccattaactaacccctcacaatctgaaaaaatcgcgtattaacggacacgtaaccgttgaccagctgaaatcgttgcgtcagatgataaaccgtttagttctaatagtttatccactgagattccagcattcgtagcgacccgatagactccttggccggcttctaccgtgacgtacttagtccctgaagatgattctgaggagctactactgctagcgctgctgtcgtcagtactcgcactttctttcgagctagcagcggctgaactagcagccttggaactggcagctttagagctagccaatgccaagctactgcttttggcagcagcctttttcgacgatgcggccgccttcttcttgctagcagcagttgatgacttgctggcagcaacactggccgatgactttttcgagctcgaactagcaacttgttcagtctgttgcggattattaagcgaattctttttcaccaaaaagtagccaattggtgccaaagcaagcaacaatattagcacgactaacacggtcgttagcgtggagttgctactgtcttgttttcgtttttgagttcgcgataaattgcccgagtcatcccgatcgtcttcaaaagttttgtcccacggcttatccgcttgggatttgtcattatcatttttttgactcatagggtgttcctcctcaaaaaactttcaaccaatattgtaacataaccctgaattgatttctttaagaatttggtaaaaacaattgagctaagcgctgttcccacgacattagcggggccacagcctcgtcatgtgtcgctgtcagccctaacgcatcaagcggtaacggttcaccagctagctgacagcactgttctgtatgagtcacggccgcctcaccaaagtaagttagcattacggcccgatgacaagtcgtggtttggacgtaactcatgagtgctcgcagttcacgttccttagccgcttggcgatcagcaaaaatggttgcaacggtctgcggcggcgttccttgtagccagtaagactgcaagactttactacggtcatccgtcggcggttgctgtgcttgataacgactgtagtcttgctggatttcattgggggtcgcagccgtcaattcgttcagattccgaaccaggttttcgtcgcccggtgcgtacaacataatcgccatcgcctgctggccatcacgccccgcccggccgatttcttgaacgtagtcggctagtgtcgttggtaagtggtagtggaccaccaggcgaatatcagctttgttgattcccatcccaaaagcagacgtggcacagatcacatccaactgtcccgccatgaattgctgctggatcttgaagcggtcatcagtcgctagccccgcgtgataggccgcgacccgtaacgtagtcgtcgtgcgcagccactccgctatcaagtcagtttgccgcttggaagtaaagtagacgatgactggtccgcgcgcactcgtcactagatgttgtaaggtcgcccgtttatgatcttcgtcattgacctgctcaactgctaaataaatattgggccgattgactgaatataagacctgttgggcgtccggaacggctaactgtgtcaagatatcttgtcgaacgtgttgtgtggccgtggcggtgagcattaacgttcttggcgcccgcaactgttgccgaatctggccgagacggcggtagtcaggacgaaaatccggtccccaagtcgatatgcagtgagcctcgtcgatcaccaataacgccagtgacacgcgcatcagcgccgcttgaatctggtcttgactcaacatttctggcgaaacaaacaagaattttaactggccgagatgattcagcaggtgctggcgagcaccataatcgagttgcgaagtcaaggcggccacttgcttttcgccttgatagtttaagcgtgccacctgatcttgcatcaaggaaatcagcggtgagaccactaccactaatcctggcaacgcagccccaacgagttggtaaatcaatgacttaccggttcccgtcggtaataccgctaagacatcttgacctgctaatattttctgaataacggctagttggccggggcgaaattcatcaaacccatacttcgttttcaacagtcgatacaattcatcttctgacatgctgacacctcataatctgaaataaccgaaattcaaagaaatctaacgtgggtaatgcagcctgggcatcctgaaacgaccagtttgcaacatctggttgcgccgcaaagatattggtcaattgctgcgttaactcatgatccagcaccatttcatacggaaaatcaggcgaccacatcgcgacttccagcaagtgttcacgtaccgtactcatctttaaatgccgggcctgcgcgattgccgcgagttggtgggtcgttaaaaatgcttggtaggtttgcagcgcactttgactgatgggactcgcttgagtgaacgccgccaacaattgagcaaatggatcctgcgggtgctgctggatccacttgatccactggcagattacatcggtgtgcatcatgtcagtctcgaaggggtgccgacctagttgttcagctaactgttcattcgttagcccgggttcttgataacctgtgagcccctggacgaagaccgttggcaactctgcatcttccaaactcgttaagaaggcggtcaaagccgcatgaatctgttcgccgagtgtcgccttcgattgacggcgcaaccattgcttgacctgtgcttgaattcccggatcagtcgtcaccggataataatggcgatcatgatgcacaagctcagagacaacttgtaaggcgagttgactgacgaccataaatcgacggacatccgtagtttgaaacacctgaaaattccggggtaagtatagcgtctgacggaactcggcttgccgttgcgcccccaccggcgttagttgccagcttcccgcggtcgtactcaccaattgaccattttcggtgaggacttcagttgccgccataaagtcttctaagggcaccgtgtgacaactgtcgagtagatctaaatagccggcggtcaacccggcaaagagtgtggagaccgtgcggcggccgcgtaagacattaaacaaactctttgctcgtcgcggcgtcgtactgaataacaataaaacgtagtctggaaacacggtgagccctcctttacatttgttaatttgaccggctcccaacgaagggccagcttaacttcttaagttggtggtgagttagcccaacttcactcaggatgacgctgctaattcgctagctggtagattaaccggtagcttattgatcttgctaagtttaggtaatcaacgctaccacgaactggcaagacgccgcattgcgcatccatgattaagtattcagcgtgcgtatttaagaatatcacggtgttgccaaattaaaaaggccgtcaccttgcatttacgcaatagatgaccgccttcattattatattgattgtgcttaaactcggctcatcagctgattgtggttgcctaaccatttagccagccgttgatagaccagccagaagacgttgccgaccagcagacccttgatcaagttgaatgggacgactgcgaccagcacgatcgtattcaacgacatgctgagcttcatgcccatcacttgtaagtagaatggcaggacgaacgtcaagttagctaacgattcaatcacaacgagtccgaccgtcgcaacaccaattgcgacgggcatccgccacttaggatcaccatgatagtaacgtagcactaatgcaaatgctaaaatcagcactgccgtacccaagaaactagcaaacgacccgattaaatcatagatggcgaaacccatcatggctgaatgcaggagcagtttgataatggtgataacaaacgcgcccccaacaccaaagagaaagagcccaatcagaatgggaatatctgaaaagtcgatcttcatccatggcgcaatcggcaaaatcggaaactccactaacattaaaatatacgcactggcaccgagtaaggctatgcccactagtcggtgtaacgttgtatgttgcataacgcaccctcctatgggtcatcttcaatgaaccgcattaccagttgtttcaaataaaaaagcccgcccgatcacactaactgtcatccggggcggacttacttgcaacgcttggcaaataagctcgatcttctttataccagactttactgtcgactttggaattacaccaaatcactatgcacacgcataggtcgcgggttattaccgccggtcgggaattgcaccctgccctgaagatgaaccaatatttatttttacaagttcattttaacggctttcgttcaaaaatgcaagcgttatcgttcaccttttaacttactaatttcaattggctttaacttacggtattcacctggttgtaaactctgcaaatcgagaaccccatagcgttcccgtttcaacttcgtcaccgggtgacccactgcagccagcattttctttacttgatgattatggccttcgtgaattgtcaattgaaccaacgcattattcttcttgtgatcactatctaacaagttcgacttggcaggcgccgtcttacggccatcgatttcaacgcctaagcgcaattgtttgagatcggcgttggtcggcacgccctcgactttagccaaataagtcttcttgacttcgtacttcggatgggtcaaccgattcgcaagggccccgtcattcgtcatgatgagcaaacctgaagtatcataatccaaccgtcccactggatagatccgctctggtacgtcttcaaagaagtctaataccgtcttacggcccttttcatcatgaacggtcgtcacgactccccgcggcttgtaaaacaaataatacacgagtttttccgcgtttaacgggaccccgtcaacctcgacatggtcactgggctccacctttacgccgagcgtggtgaccgtcttcccattcaccttaacgtgaccggatgtgatcaacacttctgatttacgccgcgaagcgatgcccgcttccgccattaccttttgtaatcgttctgccattatttatcctcacgttctgcttgtaatttatcctgaaatgcatttaaaaagaggtccgtctctggtgcgggatgctccgcgtcactcaaggccgctaaatcaatcgctggtaaatcatctagagattttagcccgaagtaatccaagaacagttccgtcgtgccgtacaagattggtcgtcccggttcactcaagcggcccgtctcggtgaccaactgtcgcaaaactaatttttgaatcgtcgacccactgtgcacgccccgaatctcatcaatttcgattcgcgtcaagggttgccgatacgcgatgattgctaagacttccaacgatgcttgtgacaaactcgtcgttagcggcgcttcaaagtagcgttttaacactggtgccactgcggccttagtcgccaagcgataagtattcgccgttgataggatcatgagggcgctgtctggatcggcttgatacttcgtggctagttgtgtgagcatcgtcgtaatcgccggcttagcaaaccccgtggcgtgctcgatttcggcgaccgtgatgccttcatcaccagccacaaataatagtccttcaatttgttcaatgttcgtcatgctgttcatcctgtcgtaaatataaatgaatcggactcagtggctcagcttgctgcaacgccacttgatcctgcttggttaattctaacacagccataaaggttgtcactaacatttcatcgctggcactgaccgtaaataggtcggcaaaatccagtccgtgaggttgctgttgcaattgcgtcgtaatttgtgtcatccgctcatcaatgttgatggtttcagcgacgaccgttttcgttagtggccgtacccgccgccgtttagccactaattgccgaaaagccgcctgcagatcatctaaggtgattcccgcagtcagcttgggagcactcaggtcggccggcactaacatcgcttcccgcgtgaaatgttgatggcgcgcttgttctttttcccgtaattcaccagctgcttcctgataaaccttataagctaagagttcggccaccagtgaatcacgcggatcatcgtcctcattatcctcttcgtcctcgtctggttcgggcgggggcaacaagaaccgactcttgatggtcatcaacgtcgccgccatgaccaaataatcaccagcaatatctaattttagtgctcgcatggagtgcaagtaatccagatactgctgcgtgatggccgcaattggaatatcataaatatccatcttgttttggcgaatgaggtgcagtaataagtctaacggcccctcaaactccgaaatcttaatggtgattggttgttgttggttgtttgtcacgattacgctcccacgcgccaatgattggcgccatttctaaagttcccatgacccgttgtttgggatacagtgcggccagctcatccaacatctgatactggttagcggccgtccgttcctcgggcgataatgaatcgtgatgcaataagataaagtcactgccgacttcaatgccaataatgccacagaaatcgccgtcaccttgccgccatagtaataattggtggtcctctgttgactgataccactgcatctcagtttgtagatgtgttaaatctttgaaatccgggataaatgacagtagccccatggcgaccttttcataatccttccgatatttaacgagcacggtattgcctcccttaactgcttacttccacaccacgtctacgctcgcggatgatacttattataaacctcagcgaggcgttttttcgaaatatgcgtataaatttgggtcgtcgaaatatcggcatgacctaaaagctcctgaacgacacgcaagtccgcaccattttctaagatgtgagtcgcaaacgagtggcgcaacgtatgcggcgtcacgtttttttcgatgccagccgccttgacctctgccttcagatttttccaaaccccttgccgacttaatttaccaccgtggttattaataaataaatagctgttccggcgtttggcagagacgagtttgggccgagccgtttttaaataacgggtaataaaatcaatggcaacatcaccgatgggaatgatccgctccttatcacccttaccgatcgtttgaatcaaccccaagtccaagtgcagatcgtccatcgtcaaattaatcgtttcgctgacccgcagcccggtcgcatacatcacttctaacagggtgcggtcacgtaatccgagcggggtattcaacttagggacggctagcaatcgttcgacctcacgcggtgacaacacttgtggtaagtgttgcgcccgcttaggcgtatcgatctttagcatcggatcagtatcgatggcgtgcatttgggcgagatattgaaaaaacttacgcaaactagacacgctatgaatgatcgtattccgcgacttgcccgcctcatcaagatactgcaaataattcaacaggatgtaccggtcaaccacccgatagtccgtgatctgctgactcatcaagtattcgctaaacgtggtcagatcttgagagtaactcttgatcgtattctcgactaatccccgttcaacacgcaaaaaatgcaggtaatcagcaagctggtcctgcattttttgatcaatcgtcggcttgctcatccgcattttcgagtagcttgatctcacctggttgttggctgatcaagcgttgcttcaacagattacccacagcgcgcttaaattgtgatttactgataccaaagtaattccgaatgtcatcgggatcactcttatcccaaaatggtaacgcgtggtccgcttgatgttgcaatgctgctaataacatttgggcgtcatcgccaatttcttcatatccccgcggcttcaaggacaagttcaattcaccgtcgcgcaaaaagccaatgacccgtgccttgacgtgttgtcccatgcgtggttcctgttcacgttctgacgggtgcacgaagcccaggtgattatcgtccgtgatgaccgacgtaccagccatcttcaaccgaaaaacggtcgccatggtatccgtattcttaacttgggcccgatcatatggtttagaaatagcctcaaagtccgtcaattcggccaacgtcgcccatagccgttgtttattgtcacgggctaacttaacgtataaacgatcatcttttttaggccatagtcgactgatagtcggtaattcgtctaatgacaccaccaagtccttattcggtaaaccgacatcgacaaagacccctagatcatgccgcgtccggacaaccgttccccacacaaagtgatcaaacgaaatttctgggacaaaccgcgtcatttgtaagtggtgatcttcattctcataaacaaaaccttcgtaaagcccgccaatgtgcaatggcttctccggttcagtcttgtcgacccacagcgtctgcccgtcgatctgtacgaagtatgcttcatcgttttcatcggttaccttcgccgtaaccaccgttccaataatactatccatgtgataactcctctgaatatccgtctaataatactaacggattgctctttttaattactgtaaacttaaatgtaagacttgaataatgcaataggttataccggccgcaataattggcccggccgcgattcctttgagcaaaacaacacccataatggtcccgaatactaacgccacggtaatctctggtgtcgctgacaaaagcccgacaccgtgaaatgagagcactgaaaccaacactccacacgcaaccgcaatccagcccactggcgacttaaacgcatgccacaggtcccgaaatccaatctgaccagtcgcaatcggaatcaaaattgcaacggtaatcaccgtcacaccccaattgatccccttctgcccaatcgtcgttaatagcttactcgtattaggaatcaatttgatgagcaacacaaccacggtcgcaatctgtaaggactgatttttccctaaccatgccaccactaaaatcgctaataaaaataaccaactttccatacgacacctcacgtgttatcaattgtaactgaaaatggcccgaattacgaggggtgttggtcgttacgcaccaatttcaccattccccctgatcaataaccgatccctattcttcaatttaggcgggaacatgattaaaaggtgccaaaacgtcaacgtcaagtgatccagcttaaacccgctggaaaagggtctatttagcgtaaacttgcttagttagcggcgtcctacaccgacttccaggcatttcggccaattgctggaacgcggtggacacagatttaagccgcagcccacgtcttaaatactggtcttccactaaccaagcaaaggacgcttgccaagtggaatttcaccgctgagcattggccgaaatgccttccagtcgggatggtattcgaatggctgacatgggtggacccagcattgaacgaattggacgttgctattttagagatagcaattttaccacgcaacagttagtttgataacataattgtgattgtacgattatttcgaattccaccgtgttagtactgaggcatccaaaacagttgagacaccattaacgcatgctcataattctcagtagtaaactcgttcagcggcaagttgcaccaagttaggtggttgttcatcagccattcgaacggcttcccgactggaggggttgggtgacaatgctcagtagccaaattattcttggctggaagtggtcttcttccggcctagaataagactcgtatttgagattgcgcagtgggttgctgcgtgagctcgaatcgacgtcggctacgttccagcaattgtcacccagccccggaggtcggaataggacgaaccttgctgactaaccggaatctccaaacgttttggcaccttttaatcatatttcatactaattcatctgggggtgaagcagtttatgtaatataaaaagccgccgcaaagcgacgacttttcaatatcaaattggatttgatcttaaagggcgtttgaagcaccgcggtatacaaggccacgacgtgaatcaacggtgatcaattgaccatcagagataacactagtagcgtccttaacaccaacgataacaggaattcccattgagataccaacaacagcagcgtgtgaagttaaaccaccgttttcaacaactaaagcactagacttttcgattgctggtaagtagtctttgtcagtcgtcttagtaactaagacgccaccttcaacggccttgtcgatagcttcttgagcagacgttgcgattacggctttaccgataaccgtttcatcaccgacaccttgaccatcagctaacttagaaccaattaattggatcttcatgatgttagtcgtaccgcgttcgccaactggcacaccggcagtgatcaggattaagtcgccttccttggcaaagccaagttcaacagccttagaagcagctaaatcaaacatgtcatcagtggtttctggtttttcagccacgattggttgaacaccccagttaaccattaagccacgttgagtccgttcgtcaaaagtgattgctaagatatcagcatttggacggtacttcgaaatcatcttagcagtgtagccagattcagtcgcagcaacgatcgtcttaatgttcaagttcttagctgcccgagcaatcgcaataccgattgtttcagtaacactagtcttgtcgaaacggtttaattgtaacgtaccgttttcagccaaagtgttttcagccttttcgtcgatcttagccatcatggcaacagattcaacagggtaaagaccattagcactttcaccagaaagcatcgttgcgtcagtaccatcaaagacggcgttggcaacgtcagaagcttcggcacgagtaggacgtgggttttcttgcattgagtctaacatttgagtagccgtgataactggcatacctaaagcattacacttcttgattaaactcttttgtaccaatggcacattttcagcaggaatttcaacacccatgtcaccacgagcaaccatcaaaccatcacaaaccttaagaatttcatcggcgttgtcgataccttcttgtgattcgatcttagggaagatttgaacgtgttccatgtgcttttcttcaagtaattcacgaatgtctaagacatcttgtggcttacgaacgaatgaagcagcgatgtagttgatttcatgatccaaaccaaagcgaatatcgcttgagtctttttcagtgatcccaggtaagttgattgaaacgccaggagcgttaacacccttacgtgagcctaaaacgccggcgttttgaacagttgtaaccaattcgcggttagcttcgtccttttcgtcgatcttcatgtctaataaaccatcatcaaagaggacatggccacctacatgaacgtcgtcaaagaggttcttgtaagtaacggcaatcttatcatgggtcgtatctaatgaatcgtccatggtgatacgaaccttatcaccgatcttgtattcagatttcccgttagcttgaacggtcgtccgaatttcagcacccttagtatcaagcatgataccaacggtcttacccgtaatcttttctgcttcgtgaactttgtttaagcgatctaaatgttcttcatgatcaccatgtgaaaagttaaagcggaaaatatttgcgccggcttcgattaatttaacaatagtgtcagtatcggtgctggcaggaccaagtgttgaaacaatcttggtttttttcataagaaaaatctctcccttgaaagtttttataaaaagacattaacgtcatttttatcaaattaaaataagaactaacatgccatgattacttgaatgaaatttcttcattcaacttatctaatgacacttcaacgtcatgcttagattcaaataaatctaagatgttgtggttgactaattggttgttttgaatcccaaccgctaagccacccttgccggcaagcaagagttccacagcgtaggcacccatcttgctggccatgacacggtctttagcagttggattcccaccacgttgcatatgagcaatggtattcccacgagcatcaaagtcaccatattcggataacttctcaacaaactcctgggcacccatcacaccttcggctaacacgatcaagttgctccgatgaccattggcccggttatgcttaatcttgttggcgattgcttccatgtcccaatcaacttcggggaccacgatagcagtcgcgccgattgaaacaccggaccataaggctacgtcaccagcgccacgacccataacttccacaacgaaagtccggtcatgactatgagccgtatcataaatccggtcaagggcttgcacgttggtgttgacagcagtgtcaaaaccaattgtgaagtccgtgtaaggaatatcattatcgatcgtccctggaagaccaatcgtgttgtagccgtgttccgttaagcgcaatgcgccatggtaagaaccgtcgccaccgataacaactaaagcatcaatcccaaaccgcttcaattgttcgatcccttttaattgaccttcttcatgggcaaattctggataacgtgcggagtatagtaaagttccgccgcgttgaatcacaccatctaagtcggctgcttctattttgtgaatgtcaccggcaactaatccggcaaagccgtaattgatgccgtatgcttccaacccttcagccattgctttaccagcaactgcacgaacggccgcattcataccaggagcgtcgccgccactggttaaaataccaatgcgtttcattttttcacctcaggcaataaattgagttcgtaactccataagtgattctaacacttttcacgtggattgtctgttattttctaaaattaaatgcgttaaaaaacgccgtcgtatcaagggatagcgttcttcatcaccacattatcgcgacctaataaggttgtaagcgctccaaccaaatctggattttctgcgacccaatactgtgaatttagttcaaccgttcgatgggctgctaccgagtaaattagaactggattaggacctcgatattgacttaagatccttaaaatttccttttgcacagtcgccgttgcttgctcaggttgcaaccgcaaaaagagttggccggttggtttaggtagttgttccgccaactgccaggtgttgacgatcacttgcagatcccgctgttgttcgaccttaccagtaattaacacgattgcttctggtttcaattccgcctgaatccgttgataggtgttgggaaaaatcgtcaagtcgatttccccggataaatcacttcccgtggcaaacgccattggttgaccacgcttggtccgaatcgttcggaccttcgtaatatagaccagtatttgtgccggttgttcactcgtgagcgtgctgactaattgcgtatgtcgttgttgcgcgagccaatcatacgtttctaccgggtgccctgaaacgtacacaccaagatattccgcttctttggccaatcgctcacctaacgagagctccggttgctttttgatcttcggcgctaatgattcaaacaaactcatactgccaccggctaactcggcgcttgacatcaactcaggtacactggtcagcagctccgcacgattcaggccaaagtggtcaaaggcacccgcataaatcaaggcgttcatcaaatccgctttgagccacttcgcgtcaatccgttgcataaactgttgaagactcctgaacggtccgttggcctgccgttcgtccagtacactggcaataaagtcacgtcgcagccccttgattgaactgaggccaaacacaatggcctgaccattccagtcaaagtactgcccactgcgattaatatctggtggaataatggcaacttgatgctgccgagcttccgctaaatactgttttagcttggtcccattgcctaacacagaattcatcaacgaggtaaagaatgccccggaataatgaaccttcaagtaggctagttcaaaggccatcttactgtaggcaatcgcgtgtgagcggttgaaaccgtagttcgcaaattgctcaatatattgatagacctgggtcgccactgcttcggaataaccattctgttgtgcgccggcgataaattgctgccgcattttgtcgatcacggcgcgtttctttttactcatcgcgcgccgtaataaatcggcttctcccagcgtaaagccacccatgaccgctgcaacttgcatgacttgttcttggtagaccagaatgccgtacgtcggtcctaagattggtgcgagctgttctgcgggatagctgaccggttcttggccttgtttgcgcgcaataaaatggtcgatattttccattggccccggccggtaaagtgcgttgactgcggcgaccaattcaaaattatccgggtgcaagcgccgcagtacatttcgaatccccgccgattcaaattggaagaccccggtcgtgtcgcctgcctgaaataatttaagggtcgcctgatcgttcaagtcgattttagtaatagctagtggcttgccagtttgacgctgcacataatgtagcgcactagccattaaggacaaattccgtaatcctagaaaatccatctttaacaggccgactgcctcaacggtatccttggtatactgagtcatcatcattgtttcactacccgcttgtagtggtacgatctgaatcaaaggtttttggcttagcaccacgccagccgcgtgcgttgaataatggcgcggcaagccttccaagcgctgggcagtttcaaatagcaacttattttttgatgaatcagcaacgagattttgtaaccgttgggaaccctgataagcttgcttgagggtaatatgcaattgattaggaatcgcggcgctccaatcactcatctcgtaactcgagaggccgaaaacccggccaacatcacgtaaggcttgctttgcagccaaagtgccaaacgtgatgatttgggcgacacggtcatgaccatacttatcatgaacataattcagcacttgctcccggcgattatcaggaatatctaagtcaatatccggcatattcgcccgtttggcgttcaaaaagcgttcgaatagtaagtcgtattgcaagggatccacatccgtgatattgaggacataggcgactaatgaaccagccgcggagcctcgcccaggcccggtcgtaatctgtgcttcatgagcaaagttcatcacgtcccagacgatcagaaagtagtcgtcaaaccccatctgatcaatcacggtcagttcgtgatccaaacgatcctggtaggcttgttgatcaacagaccccgtcatcgcagccaggcgctttgtcaggccagccgtgcacaactcgcgtaagtagacgttggctggctgttcagttggcgttggaaattgcggtaactgcggttgttgaaattgtaattcaacttggcactgcgcggcaatttcagcggtggccgccactgccaccgtcaatccaagttgctcatagtcagccgttacggtgttggctggccgtaaatagtgactaccctcaatgccctgcaacgattcaggctgttcgatctgttggccccgatcgattgctcgcaaaactgaaacggcaaagtaatccttggcctggacgtagtcgactggatctaatgctaccaccggtaattgatgctgctgtgcaaaggccgtcattgtcgttcgtaacgcgggagcctgatccaaagaaattcctagatataggctgtcagggtcgaccgcctgccgtaacatcgtcacccaatcggcggcttgctcagcgttgttttgtaatagcaatgctgctaattcgctgtctttagccggagttaagaccattaaatggttcaaatacggtaatacgactgttagcgataacccggcatccgtcgccgtctgcttcatcgtcgacaaccgcatcaagttttgatagccagcttggtctttcgcgagcacgaccagcggatacgtttgggccgttagttcatgtcctaataggttcaacgttatacctagtatcggggtgatttccgcctggcgacaggcattatagaaatcaacaatcccgtacatgacatcaacgtccgttaaggccagcgctgaatagccgtgctgcttagcagtctggactagctcactgacagtgctagtgctttgaagcaaactaaaagtactcaacacttgcaatggaacatattgtgccactatcgccgccccctttcataaaatatcagctttcaactcgcatcgaaaacgtaacatcagatcagctacgtcaagcccgctccaaattgatgggtaaacaaagaatttaccagtctattcaatgccagttgatgaccaatcttgtcctcagatatattcgttactattcattataccaaacagttgttctaagcggcagttttaagtcatcagataacgtgcacggttatgtttactagggtttcaccgccgtctcgtcgtaattatatcagcctaattaaagccttaatatcccgttattacctaattgctttttcctgtcggtgtgttaaaataattttcattgggaggtgtcggaaaatgatgagacaacttacgattatcttttggagtgtcctcttcggtgaggtcatcggctatatcggtggcgccctcgaacaactctcctataatcctggtgaaattggcatcgttgctgcaatttttgcgctagtcgtggtcaacagtatcacatatattactaatcattcccaacccgctaaaggttcagataataagtaattaaaaacaaccagaggctttgctccgcttagtctcagcacaacaaaaaagacgagtaccccgattgtggttgctcgtcttttttgttgtgtgcttggcaccctagccaactcacaatgataatccgactaaaaaaactggaccgtgagcctcccaagatgctcacattccagttttcattgacctagctatcgtcaccgcaacgcattttcacgcgtcccaatcagcgattgcaccggccgttgtgcttatgccggctgggtcgattggttttcgaagactaagtgatcgtccatcaaattaatggcgaccgtcgatttgggtgccacgcgacccgcaatgatttcttttgctaggggtgtttcgacgtgattcgtgataaagcgccgcaacggccgagcaccgtatgccggttcatacccctgcttagcgatccacttcttggcttcatcagaaattttcagtgtgatttcacggtcctggagacgagccgacaaccgatcaatcaatttcaccacgatttcctcaattgcacccaattgtaacggcgtgaacataatgatgtcatcgattcggttcaaaaattctggtttgaatcgactttgaaccagctgcatgacctgttgatgcgtctcatccgacaagtgaccctggtcgtctactcccgcgagtagtaactcggagcctaagttcgacgtcatgatcaagatggtatttttgaagtcgacggtccgtccttgtccatccgtcaaccgaccatcatccaatacttgtaacaagatattaaacacgtctggatgggccttttcgatttcatcgaataaaacgatcgagtaaggattacgccggacagcttctgtcaactgaccgccttcttcgtaaccaacgtagcccggtgccgccccgaccaatcgtgaaacggattctttctccatatactcactcatatcgatgcgaaccatatgatcatcggcgtcaaataaattctcagccaatgctttcgctaattccgtcttaccgaccccagttggacctaaaaacatgaaggagcctagcggacgattaggatcttgcaaaccggcccgcgaacgtaatacggcatccgaaacggcatcgaccgccgcatcctggccaaccacccgttcatgcaaatggtccgccaagtgtaatagtttctcgcgttcaccggcaaccagcttggcgactgggatccccgtcatccgggaaaccacgttcgcaatctgatccggtgtgacggattcctcaactaaccaatcttcatgatgatcattggcttccatgaccttcaactcttgttccagcttgggaatcgtcccgtgctgcaacttagctgcttgttccagatcatagttgttttcggcattttctaagtcgtgtttagccttgtctaacgccgactttttgtcgcttaatgcttggagactcttcttttcactgtcccaacgttcggataaagcccgctgtttttccttagcgctggcgagttctttttgtacatccgccaaccgtttaacggaggcatcgtcagtttccttcttcaaggcggcttcttcgacctctagccgcattaattgtcggttgacttggtctaattccgttgggttggagttcatctcgacccggatttcagcagaagcctcatctactaaatctaaggccttatctggcaagtaacgatccgtaatataacgatcagacaatttggcagcggccactagggcgttatcatgaatccggacaccatgatggatttcaaagcgttcctttaagccacgtaaaatactgatcgtatcttcaacgctcggttcagcaaccaatactttttggaaccgccgctcgagcgccttgtccttttccatgtactggcgatactcatctaacgtcgtggccccgatcaaatgaagttctccccgcgccaacattggtttcaacaagttaccggcgtccatactgccttccgtcttaccagcaccaacgatattatggatttcatcgatgaacatgatgatctgaccatcgctcttcttgatttccttgaggacagctttgagtcgttcttcaaattcaccacgatacttcgccccggcaatcagggaccccatatctaacgaaaacaacgtcttatccttcaaattctctgggacgtcaccccgaacgatccgttgtgcgagtccttctacgatagcggtcttcccaacacctggttcaccaatcaagacgggattgtttttcgtcttccgtgacaagatccgaataacgtccagaatctcttcgtcccggccaattactggatcttgattcccctggcgcgcctgtttaaccaagtcgaccccgtacttttccaaagcttgatactgatcttcctgattacgcgacgtcacccgctggccaccgcgaatacgatcaacggcattcttgacttgtccagccgtgatgccttgctgattcaagtatttggtcaactgatcaccagtttgatccatcagcgctaaagccaaagtgtcggtcgcaaggtaatcatcacctaacgctttgcgcttagcatcggcagcctgcatcagcgtcgctagactactgctcatactgccaccgtactgaacgttaccaccgctaacaacggcaatgtcatccagctcacggtcgagctctgtttgtaattggtctaactcagctccggcctcactaaagatctgccgaacaagttcgcctggttgcgttaaaaatttaaatagatggggcaccccaatttcttgatggcgccgtgtttgtgcgatttgttgtgcctgttgtaaggcttgttgtaaactttctgtaaattgttctggattcatattcacgtacctcctcaaaaacggtagcaaaaaggcagccgtcatagctgccaattttcgtttgacctttattgactattaaagtataacccgtaaggtcaaacaaggtcaagaatttagtcctggtcataattatcctgaacaatttgtaagacaacgtccacggcctgggccatcacttgttctgaaacgtattcaaaccgaccgtgcatgttctcaccaccagcaaacaagtttggtgtcggcaagcccatgaatgagatcttggagccatccgtcccaccacgaaccggataaatggcgggcgtgatcccgagcttgagcatggcttgtttggccaattcaacgacccgcatatctttttcaatgatttcgcgcatattgtaatactggtccttcatctcgaccttgatccgggccacaccgtcagctaaattcagccgatccgcaaccgccaagaatagccgtttacgcgcttcgaacttatcgcggtcatgatcacgaataatgtaggtcatcttggcgctatcaacggtcccgtctaaactaagcaagaagaagaacccttcacggccttccgtgtgttctgggacatcatgtgcgggtaacgccgattgaaaatcaacggctaactgcaaggcgttgaccatcttgtccttagcttcacctgggtgaacgttaactcctgtaatcgtcaccgttgcttgggccgcgttgaacgtttcatactccagttcaccaagcggaccaccatcgacggtataggcataatcagcgccaaaggcaggcacattgaagtgatcggcaccagtcccaatttcttcatcaggaccaaaggctaaccgaatcttgccgtgtttgatttcaggatgggccaacaaatattccgcagcactaataatttcggcaacaccagacttatcgtcagctccaagcaacgtggttccatcagtggtgatcagcgtgtgaccagcatagttctttaagtttggaaagaccgccggatccagcacatagtccccgtttccgagcttaataactgattcaccgtcataattgtcaacaatttgtggattgacattttccgcattaaagtcagccgtatcaatatgtgaaatgaagccaagggtcttaacggctttatcactattagcaggaatcgtcgcaaaaacgtatgcgctttgtgcatcctgttcaacatcgctcaagcctaagtcggtgagcttactcattaattgctttaaaaaggccgtttcacgtggtgacgaaggaattgtcgttgattcctcatctgaacgactattaattttgacgaaggttaaaaaatctgaaattaagtttggatattttgacatatgataacttcctttccttattaaagctcatgattaacttagatgaaggtaaacggatccgtattcagctgagacgccacaatctcgatcggccagccagcttgtacacgccattgatcaaacagcttagtaagttgtggcttacaaatactctcgatatggtggccgggatcaatgaccgtcaacccggccgccaacatatcgtgaccggtgtgataataaacatccccggtcacgtaagcctgggcacctgcttgcaacgcttggggatagaacttgccaccatcgccgcccaggacggccacccgggtaatccgttgtcggggatcggcactgactagtcgcaggccactgacaccaaatactcgcttacactgttcggcaaatgcctgcactgataacggtgtcggcaaatcaccgactcggcccatataatactgatgaccgccagataacagtggcacaacctggtaatcccacgtgccagcggcgaggtcattaatgcccgctaccgcagtgggaacctgatcaactagtaagtcgacgctgaactgttcacctgagttgacagcgtaacgatcgagtgtggcacccacggtattcgttaagtattcctgtaccgtttcaacttgatcagtcggcaccgtgagggtcatcttaaccgcctgtgcacggtagcccgggactaacccctcaacattttgcaagtcgagggccgccgctagccaatcgttcattccaccctcagcacagtccaagttcgtatgggccgcgtacaccaagatgtgatgggctgcgagttctgcgtacattgctttctgaggatcctgataatcgagattgttggccggccgaaacatgacgggatgatgcgcaaaaatcatgtcagcaccgatcgtgatggcttcttggacaacttccggccgcacatccagggtaactaacaccttgtggatgtcctgatgaggatcgccgatttgtaatccggtgggatcatgctcccacttcaacttgagtggcgcaaatttttcaaaacgcgcaattaattcacttgcttgcatccgtcaagactccttcaatcaatttgatttttgcgtgagccagcgctaaatgctccgctggtaacactttagcccgttgcatttgcgcaaccgccgcatttactcgttgtaactcacgttgccacttagcgataaacaccggtgacttctccgtgagcagaaacggaccaaacaactgctcagccgtcgtgtacgtcaccggatgatcaacccgatcagcacaaatgatctcataagtatggccatcttcagctagaatgcgctcggccacgatttgaaactgattggccgctagccactcccggacggtcgcttcaccaacgttcggttcgagtaccaaccgttgaacaccggcgagctgggccgggccttgttcaagaatgtggcgaatcagcggaccgcccatcccggcaatcgtgaccgtatcgatacgatcagctggttcaatcgcagcgaggccatcagctagacgggccactaaggtaccggtaagtcctaacttttgaatctcatgacgcgcattttcaaagggcccccggacgacttcaccagcgacaccataactaatttgatgatttaatgcgagattagctggcaaataagcgtgatctgacccaatatcggccacgcgggcgcccggctggacgaaagcgccaaccgttgctaatcgttttgataattgttttgcatccacgtacagttcccctttaattcgggaagatttacccacacgactaactttcagtggttgtggtcaaatccacccggttcaattgttttaattattcagtttaactaaccacgcacgtcactcgctatccttagtatgcaccaaaatcgaaacgtgctggtcgttgaattacgggtcggctctttatcagaaatacccaacgaggttcaactaagatcatggcaatacccaatggcctggaagttagcagtctgaacaaaggtcaaagatgattagacctttgttggccaatcatctttgaccttaaaaaccaacgcatttcaatggtgattcaggacagcaccagtatcgccgtacgtcactaatcatattttaccatgcttcaccgtgaatacgcattcagctggttaatttttcctgaaaattcctaagctttgttcaaactaactaaaattctattaatgcaagtttagttgataggtagacgtgccataatatggctaatgtcgactggcaagcgacatattatttaatgagagaaagtttgattaaccatgcgaaaacgtcttttaacgacgtcgccatttttgactggcttaaaactattagctatcctaccaccggtgggtatcgggtggctgatctacttaagccggtggcaatggttggcgttactcaaacacccgcggcagttcagccggcacgacccgttgttgggctttatcgtactattaatgggcatcacgacgctcaatctcaatcatcgcgactatcgaagcgtcattctatctgtcctcatgctttttgtattaggcaatctgtggctactatgtcgtgagtccacacaatcgattgcttggcacgagatccgtaaattcatcattcaatttggcttgtatattacaattagtggttttgcttttcattggcttaaccaattattgacgttacccacgtggctaaagttcatgctaggcgacctcttatggtgttacgccgctaatcaaaaccgcttgtttgggtccgcctataatccgaatgacgcctgctgtttattattgattgccctcggcttactattgacgcagttaagccatgaaagcgctcaccccttcacacgttggccactgatgaactggtttttcgtcggcctactttgtgtgggtatttatcaaaccaaatcgcgcaccgggctcatcatcatgattatcattctaattatgacgacgtaccagctttgccgccaccatcgcatcttggttacgacaatcttaaccaccggcagcttagttgtctggcacgtttttccgcgcagtgcttcgaccattaccgcgcttcaaagtcgcttgacgatttggcacaacagcttcaccgtcttcaagcaggccccgtaccttggcgtgacgtatttcggctttgcccggcgctatctgcaattgacgggaacctatgtcccacacgctcacgatattttgctcatgctactcgcttctttcggtatcctcggcggtgccggttttatttacttagtcctgagtagcggctggcacttaaccaaatattggtgccagtatcgtaccccgaatttgcgctactttatgatgacgttgcccattattctggcctatggattgacggactttgtcttatcttctatgcaagtattgattattattttgctcattatcgcttgttggcaccacgaacaacaattacggccaatcattggtccgcaccagtatcagtccccgctgatctaacgcgggacatggtcatcaactttaaacgggcccgtatcgcccatgatcacaaaaaggtgtgcgctgccggttaacctacaacgcacaccttttttgggcaaaccattaactaaaccggcgatacgcccagatcgtcaacggcataaaaatcgcaataatcaggcccccactcattagaaccccaaatgcattcgggccccactgaccagtccgcaaaatcgtgcgaatcgcagtaatcgttacgctgaccgggttcaatcggacaattatttgcagcgaatccggtagcgtcttggtcgggataaaggcgttggacagaaaagtcagcactaaaataatgatcatcgacagactgccgatcaaggctgcatttttgaccattaaccccaccaacgcaaagacccatgagagcgaccagccaacaaataccgccagcaggaggatactaagcaatactagtgggctagtcgtaggtcgccagcccatcacaaaggccgtcaccagtgccatcaagccagaaataagcaatcggaaaacatcccccactaactgaccggctaacggtacgattggtgaaatcggtagcgtcttaaagcggtcaaacacccccgtattaatatcttcacgcaattgttgcccagaccccgacgccgcattcaaaatgctttgaatcaaaataccggtaactagcattggcaaataggcctggacactacccgcaatggcgccaccaaataagtaaccgaatagcagggtaaaaatgaccggctgcatgaccacatcgctaatattatccggattatgccaggtttttagtaaattccgatgtgtcatcgtcaaaacatggcttaacactgttggttgtttgaatgtcatcgctttttcctccttcaattcgcacccacggttaacttcaaaaacacgtcatcaagcgacggagtatgcactgcgaagctattgatcgtgatttgagcagcttgtaaccgcgtcaaaatttcagtgaccggcgtcaagctagtggtatccaacggcacggttagggtccgttctgcaacgcggacattttgaccgagcatggcttgtaagatatccttagccggtgcaacggccgtcgtcgcactgacttttaattcaagctcttgaccccctactgtttgtttcaaagcggcgggcgtcccactagcgaccaactgaccgtgatcgatgagcgcaatgtggtcggctaactggtcggcttcttctaagtactgagtcgttagcaccacggtcgaaccatcggctactaattgacgaatcgcttgccacatctgcgctctggtccgcggttccaagcccgtggtcggttcatcgagaaaaagaatggtcggtttaccaatcaagctaaccgccaaatccaatcgccggcgcattccaccagaaaacgtagccaagacgtgatctgcggactgagtcaaatcaaaagcggtcaataattcgatggcccgattctttgctgctcgacggcttaagccgttcaaacgtccaaaaatctgcaaattttcccgcgcactcagatcctgatcaatactagcggtctgaccagtcagaccaaactgctggcgaacacgtcgggcttgtgacaacgaatcaaaaccattgaccaggattgtcccagcatcttgtcgcaaaagcgttgtcatcatcctgatagtcgtcgttttgcccgcaccgttaggacccaacaagccaaaaatttcaccccgttggacttgcagcgacaaatctcgaacggcgactttcgttccaaatcgcttctgaacatgggtcatttggatcatcatttcttcattcaagctaaaacctcccaaaaattaatcagggcccctgatgaaatatatattaaggccccctgactaaattgtcaacgactaattattgaccatcgatctaaaaaatcaactaaccttaacgtaccgcataccaaagaatgttgtatacttaagaaaagaacgaatggaatgatcaatcgtgacaacgaatattaaggcggaactagtcgccggaaaattggccgagtacgaacaactaagcaaaatttatgatgacattgtcaagcaggcccgtccaagaataaccgttgaaggtcagggcaagattctactagcactagccgatgaggaccacctctcacaaaaacagttggcaagtcgccttggcatgtcgccgcaatcaacgagcgagtttgtctataaacttgtcaatcgtcagctggtcactttatccaagtccaccaaagatcgccgcgtcaaccttgtgaacttaacggctgctggtcgcaaagagattgcatccgcagcccaggaggtccccccgtttgtcaacacgctttctgacgacgaactcgatcaactggcactcttgttaaccaagattaccaccgcgatgtatgcggatattgacgctgccaacccgactttgggcgttaagtttcacaaattatttgctagtcggtacttgaagcagttcaaaaagtaagtcatatgccacctggtcgtcactttcagatgaccacttgctccgaattaaccatgaatcagcatttggctctaaacaaacttaaaggcggaccaattcagttacgaattggtccgcctttatacaccttacgattgttcctgcagggcgcctactagatcattggtagctggtggattagccaataaatctctgacatcatcaaggtccaccttaacgttccagatcaagactcccgccaacttattctcatcgatgaagtagacaattgtcccgtgagctcgtttatcaaaaatcgtttgtaattccggatcaatgttgccaatagcttgccaagaaatatcaaaaatcattgaatagaaatagggcgtatgttgatagtttacgtgtgcccccgccatattacgacctaccaattcgccagataagcgcgcatgatcaacgtgttcgatccgttgacgacctaaaatccggtccgggtaagaggcaatatcaccggcagaccaaatcgccgggtcactggtttgaaggtattcgttgactttgaccccgccatcagccaggtctaagccgctttcctcaattagactgattcgtggtgtcacacctaatccgataataatcgtgtcagctggcaccttggtaccatccttcgtcaagaccatcaactggtcaccctcgcgctgataagattcgactaactgaccgcttaagagttgcgccccgttcttcttgaaagtttcttcatattcagcccggatttcttcagggaacttccctgatccaagtgagtcttcagggaagatcatcgtgacgttagtcttattttgtgtcaacgaggaagccaattccgtccccacgtagccaccaccgataatcaccacgcgcttgttagcgccactaaatttccgcaacttccgataatcagaccactgtctgaacaccaacacgtgggggtcttctgggccttgaattttccgtggctcaccaccagtcgcaactaacagttgctgataataaatcacttcaccatcatccaatgtgattgtctttgcctgccgcgcaatcttcgttaccgttgttttgaacttgaacgtgacgtttgcgtaatcttcagcaccgattcgaatgttttcctcagtgaattcatcatctaaccataactttttacttaaggccggccgttcgtacggaacatctgcttcctgtgacactactagaatggcgccacttggatcttcttgtcgaattcctttaattgcgtaaccggctaccatcccaccaccaacaatgacgtatgggtaactattatcatcatttgttgcactcatcgtatcgcctccattagtattcttacttatcatcattataatatagcgactgtctgtccgccaaaagcacgctctaagtgggcccagataacttcattaaattctgagaacgattagttcaagccacgaacacagtcgttcacaattattgaatggcccagcccaaagcggtacgtttaaattgtacacaattaatattgttaatgaaagggaagtgcgttactatggcaaacaatcagaaacctgaattgacgacggccgctggacaaccatgggttaacaaccagcattcacaaactgcaggcgaccgcggtcccgtccttttacaagactatgatctcttagaaaaattagctcattttgaccgtgaacgtattccagagcgagtcgtccatgccaaaggtgccggtgcgaaggggttctttgagcttgagaatgacatgcatcagtatacaaaggccgacctcttcaacggcattggtaaacagacacccatcattctgcgcttctcccaagttgcaggcgaaaaaggctaccccgatacggttcgcgacgttcgtggctttgccttgaaattttacacccaagctggtaattacgatattgtcggcaataacacacccgtctttttcattaatgatcccttgaaattccctgattttattcattcacaaaaacgcgaccctcaaaccaatcgtcgaactcaaaacatgcaatgggacttctgggcgcactcacccgaatcgttgcaccaagtcacttacctgatgggagatcgtggtctgccagcctcctaccgtaccatgaacggttacggctcccatacttttaaatgggtaaaccaagataaccagcagttctgggtcaaatatcacttcatttcagaccaaggcgttaaaaatatgacggcggaagccgctgagaaagcaatgatccaaaacattgattatctgcaagatgacttatatgatgccattgagaagcacaattacccgtcatggacattgtatgttcaaatcatgccatatgaagagggacgcaattatcgatgggatatctttgatgtcactaaagtcatctcacacaaagattatcccctaatcaaagtcggcaagttgaccctaaacgaaaacccaacgaacaactttaccgatattgaagaagcggccatgtcaccggccaacttagtaccaggaattgaagtctcgcctgacaaactattacaaggacggttattctcatacaaagacgcccagcgctaccgcctcggtgccaactttgaggatctcccagtcaaccaacccgtcatccccgtccataattatgaacgagacggttttatgaaagctaacaaccagggcgcagctgtgaactacgaacccaactctcagcgtggcccccaagaaattcctgacgcaacagtttcaccagaccaagtcaacggaactactggggcccgaccttaccactatcaagtcgattacacctcacaagctggtgatctttatcgcttaatgacgccagcagaacaggaccgcctgattacgacaatcagtgaatcgctcggtcaagtaacgcttcccggagtcaaagcgctagaaatcaaacagttctatgcggccgatgcgtcatacggaacgcgggtggcaacggcgctaggactggacattgaggcgatactcaaatcataactatctcaaaaaaacatgataatcaatttcacaacaagtgcgcgtctgaagttaaagcttcagacgcgcacttgttgtatgtctatattcgactaatctgacctagcaaacggttagttgcctactcagcgacaattcgaattgtactaccaactctaaaatcaggataatcgccctgctcaacatataacgtcccaggcaatttagcctcctttgcacccgtaaaactaatagccgtatggcctaatcttccaaggttagtctggacttcgccaccaactgctgtaatttgatagacttgattgtcgacttcaagtttcattcctgctgtgatttgctcacttattgggacaacttcgataataaagcaagaaggccgtaatgcgtctggagcttcatcaccaaataatactgccatgccaatcgatttaaaatcagcagattccgcacctatttctaagacctttgttgaaaagataattctctcttttgtcatcatacaatacacctcaaaccttctaaaaatttattttgaatataatccaaaacttgcaatccaagcaataaagacccgcggaacgccgttgataaaccgactatataacactgatggcaccccaacttcaaccgtcttagaatcagcctcagctagtcctaagccaactggaataaagtcacaaccattttgcgtgttaatcgcgaataatgctggtaatgcatactgtggtggaatattacctttcccgatttcaacgccaatcaaggtcccgataacttgaccgataactgcgcctggcccaagcaatggagataagaatggcaatgaacaaataaaacctaaaaccatcagaccccagacattaccggccaacggctccatgacactggcaaaaaccttaccaattccagaaccattaataatcccgataattaatgccacaaatgccataaatggaataatggtattaataactgtttgaacagcatcttttgcggcctgattaaacgtcgaaacgactcgcccagcaccaatcccaatcttagttaagatcccaggattttttgtttgtgctgttagtgtctttgtattatcgaatttcgtatcgtcatctacattctcaaattggttagcgctttcattttgactgtcagaaaattgctccccctcagatgttaccaacataatctgatcaacatctacattggaaacataattagcttcattcataaattgcgctaagggaccgctcttaccagtcggtaatacgttaattgttttgatacccttcttgggataaattccacaccttaatgtcccaccacagtctacaaccgctaatgctgtttcttcatcaggaattgacgtcttaaagccatcaacagcttccattcctgtcaacttagcaatcttatcaacaattgctggtttattacctccagtgacataaacaaatttatgcttcgtgatagttggtgtaataattagcgggccgccccagccaccagagcctttaacaactttgatactatgatattcctttgccatgatctcgttcctcactctctcaattagccgttaaattcaactttcttggacaaggtaatcccttgttgtttgcaaacataggccgttgtaaaatcggtaatccaaccaccaataaagttcattaccagaccaactaatagatatcgaatcgccaaatccatcgtattcaatcctaatttctgaaccccttgcgcaatccctagccaaatgaagtactcagaaggattgatatgtgggaataccccattactagtatggcaaaattgcgctattgaggcataccagctaggtttatagtattctggcaagaatcgtcccatcgagtgtgccatgggattaccaagcataaatgccgaaacaaacggtaaaattaaatagcgggttacaggattctttgacgaagctctggccaacttggccatcttcttgtcaccaacaaaggcaataatcgcgttcatcaagactaacagtaatagtacaacaggaataattgatgtcatccatccaattaatgtcttaccaccgctctgaaacagccccataaagcccgaggccaaatctgtaactactttcatagtattaatgctcctttacgttcacttgtttttttcgcaaatttgctaaacctttataataaatagatttcagcttttcaatcattggtaagctccaaattttgacactaccatcgaaatcttgtggcgttagctgatttgctttgtaattgagatagtttttataagcatccaatagacaaactcgcgttagcttatcgaactgttttaactgttggtatgaagcagcaacttccgcaatgtttttccgtcgcagttggtgtaattccctgaactttgcaaaaatcgtaacacccttcatcatttgagcctctaggattgtgccatcatcctttatcgctaatagaattagtgtccccgaccgcaactttttgggattcttgccaatcgcaactggcgccagtactcgtaattgatgaaaggttttagaaaaattcttaatttgtcttagtccaaggagaccttgtaatagaaacgcactgactagaatcacgccaaaataaattaacattaaatcgcctccatcaactgatttaacccttgattttcatcataatttttcaaattattgtaaatattgctgttagctgtgatactacgaattagatcatatacttgtgctaatattttgcttaacgttgcatccaatttatacggaattgcgaccaaaaaaaccacgtttaccttttgattatcgaatactaccggtttttcaaacactcctactgttacaagaattcgatttagtccagatttatcaataacatgtggcaatgcaaccccatcaccaaaaatactacttgattgttgctctcgattaagccaagcttgcataaaatctggtgtcagttgaccatgttgaatctcttgagtaattaattttttcactccagtgacgtaggtctcctgttcatcaaactgcgtgacatcaaatcgacactgtccctgattaacagcttcatcaaccaacgaaatttgaagacgttcacgtaacgttccttgattaaaaatagaattcaaccgaataataggcgcgtggttgattaattcattatctgtcaaaaaactgtttgaaaagatcaataaatatttttctggactctgttccaattcacgaatcgagttaaaaacatcaatctgcaaatcatcatctaacatttctttcaatttctcagaaataaactttttcatactagtattaatgggctcaactagtgctacccgatgaataattggcgctgccatgtattcttcaagctccatctgaaaatagaccgttaaataaccaacttcctggaaacgaatccgaatattcaacttagtagcaatagttgataatgttaattgcgctaactccgtcgaaactggatacttacttagcatgtctaccgagataaatccttctgacttaacatcaaaaatagcccgattaatgagaaataataaatgatagcgcaactccatcaacaaccgtttaaagtccaaattcacgtctaatttttgcttaaggattggaaaaaccgactgcattaaatcctcaactttgaccaatcccacttgaactaactgactatcatccttcggtagctttctgatatttagtgggtatgaaataaactcccattcgctagtgcttaacgagctaccaattatctcagtaactagattccgcaatgacaccatcgttacgtcactaaggagtggatgatagttattaatatgatcactgatttgaatattatatttacgtaaccaattaataaccgcaatatttcttttaaccatggtcaaagtatcattattatgatcaatatttttcacaaggttaagcaatttggcatctgtcgctttatcccaagttgcttccagttcgtagtattttccaactaaagttcgtgtaattactgcatacatataatcatgttcaacagccaaatgaatcccacgattagtttttgtctcaattctgacttggtaataatcaagctgttgtttgagcgcttttaaatccttattgatagtgccgcgactcacagccaacgattctgccaaatcatccagaataacgtaatccgtgatttgctgtaacaattcttttaaaatcgttgcttgtcgctttgagggatcattaaaatccaaatcttttttcaaaaaattagtttgtagcttagccatggcagaataattattgataactaggtaaaacttagcttgattaacgttaatttttgcaatacccaccaaataatcattgattgcacgaatattcttggtaattgtgactctcgaaacagagaaatgggattgtaattctcttagtgtcaatgcatcattattaataaaaaagtttaatatttcaaaactttgcctatccattgcctcaccatgcccccaactaaaatttaaaggttatccgcggcttttgcctcccgcaacgttaatcgtaaccccagtaacgtaactggcacgttctgatagtagatagttaactgtatcagcaacttccgataattttccactccggccaagaggtgttgttgacgtactcttataacccgcccgaatgtcatcaacagttttatgccgggtataagccagtgcctcttcataagagcgtgttcttaatcctgtagcttccataatacctggcgcgacaccaacgacccgaatattatgttcacctaattctttagcccacgaacgagtgaacccattaatcgctcccttagttgctgaataaacactctgtccctgtgagccttcaagtccagcttctgaagacatattaacaataaccccgtactgttgcttctcgaattgatgggtaactgcctgcgatacaaggaagacgcttttcacgttcacggcaaacattttcgcaaaatccgattctgcgaattcatacttgccgtggggattcttggcatcagccaataaacgtggcaaattgataccagcattgtttactagcccgtcaatttttccttgctcatcaacaacctttgcaaccagccgattaaccgcttccgcatctgtgacgttggtttcaacaaagtgtaaattatcattttgcagatcactttgattgaggtcagcattataaacaatcgccccgttattcaacaattcagttacaattgctttgccaatcccggatgagcccccagtaacaacgtataccttacccgaaatattaatccatgaattattcatcaaaatcgctccttaatcatttcttttcttcacagataaatatatacgaaagcgcatacattattaatgcactcttttttcattggctttttaaattaatagactaatgattcatcaaacatttagatgtctgatataaactataaatattatgccgaattattttcattatcgccatatcataaagcaaattttgtaatcgaccattgtaatcaataaccgtaaaaatagagtcgctttaaagaagcgtataactccttcaaagcgactctattaaatagtcttataagccatattaatttgttttagatcgtcaccgtaacggccgctgccgcaataatcagtatcagtccaccaatcgtgacccacatttctttggtagtcttcttttggcctaagaaccaaataccggttaacgttgccaatacaacggaggtttgtgaaagaataaagccggttgctaatccgttcatatttggttgcgcagagattaagtaagtcaacgccgcaaacgcgaagaagaaacctgagatgatgtgcgtgtatgacaccccttcaacgagggctaacttttcacctcgtgatgctaagaacagggcatatacgatcgaaacaataaccatcccaattgcttggggaacgaaggcttcctccccaccaatattggttgcttggggcgcagccgaataagcccagtacccgatttcaccaactgctaaccagataacagcttggcgtaaggtccgggcgttacctgcatccttatgttcagaccacactgttagccaggcaccaatgataatgccaactaaggctaggccacccaagaccttgtccattgccccaggccagtcacctaaggcgaagacgccccacagtgatgcgcccaacagctggaaggccgtcgtaattggcattgctcgtgaagaaccaaccatcgtaaacactttaaatgtcacgatttgggcacttgcccaaccgatccctgatagaattgaaaaccagagattcatgccgcttggaaaagcaatcccttgcacccatgcataaatcagcgcaaagattaacgttccaatagttgaacccaagatctgattaacaggccgaccaccaattttcgacgcaatcgtggggtaaagtccccaaccaagtaacggccctaagccaattagtaaagcggtagtattcattccaatccctccattaatcgccaactactttaaaaagtaacgccactttccaacagaatgtttgaataaggtgtcatttcaccagtccgaacaaaggccttgcagtcagccaagtccttcttcatttcttcatgtggaatgaaggtaattggggtgtctggtaagcgtttcttgatggccgtcaacatcttaggattttgaactttaatttcttcggccaaatagattcgttgtacttcaagctcttccaagacgttattcaagacttgcataaaactaggaataccattatcaacggctaaatcgattttttcggttgaacttggtactggcatgccagcatcaccaatgctcaacttatcaaaatggcccatcgttgcaataacacgtgacaaatctgaattaataacttttgtttttttcataattatttaccctccgcggctgtaatttcatttttataaggaattgatggttgcgcaccgaagcgttgtacggcaatcgatgacgcctggttaccatagcgaatcgcatcttcaagattactaaaatctttatttaacacactactcattgcgccaataaacgtatctccagctgaagtcgtatccacggcttcgactttaaaggctggtacgataccatatcgcccatcgatatcataaaacgcacccttactaccaatcgtaatgataacagctgaaataccgagggcgtgtaatgcagcggacgcctttaacatgctggcttcatcggtgattgcgattccggtcaaagtttccgtttccgtctcatttggtacgatcatgtcggtaactgctaagagttcagcgggaaccttttccatggctggcgcgggattcaagattgttcttacgccagcagcctgtgcaattttaaaggcttcgaccgtactgtcgacagcgctttcaaattgagcaactacaaaatcgctagcttcaatgatatcgcgatgggcttcaacgtctgctggcgtaaaggccatgttggcaccaccatgaatcataatttggttttcaccggcatcatcaaccgtgacgtaggcttgacctgttgattggttggtcatctttgtgatccctgccaagttgatcttttcttgcgtcagtaaatcaagcatggttttaccagcagcatcgtcaccaaccgcaccaataaagtgggtattagcaccagaacgttgcgctgcgacggcctggttcgcgcccttaccaccaccggctgaaaagatttccttagtgtgaatcgtttcgccaggctttggcatgttttcaacccgaatcgtccggtctaagttgatactcccaataacggttaccgtattcataatggtccctccaaatagttaaattaatctgaatttagtttttattaaaacgttttatgaaaacgttttaataactcgtaaaaaatataacacatctgaataattaattcaaatgtgccgtcgaatttctttcaattaatttaactggtaagtggtgttcttcccatggttgctgcggattagcaatacggtcgagcaactggttggccgtcgtttgccccaactcaaaaatcggctgtgcgatggttgtaagctggggtgcgacgtattggcacatttcgacatcgtcatagccaatgacactgtaatcatccggtatccgtttaccatgttcagccatgcctaagtatacaccgaatgcgatttcgtcattgactgcaaagatccccgtaactccagtcgccaaaatttccggaacaacttggcgcccacccactttagaaagcggcgtcgcgataacatgaaccgctgtccgcgggtacacactataaaacccactaagccgcttttgaacattggctgacggttttgctggaataagaacggcgacttgctggtggcccagatcttttaagtgttgagccgcttgccgccccccatcatagtcatcagtcaacacagaatcgctgaacccttcagcgcgcttttggtctaagacgataaatgggtgccccttttgccgtagaatatcattaatcgcattattggaaacggccgaactcgcgataataaagccatccacaccccggcggctgagttcatccaaatagacgcgttctttgtcttcatccagatcagcattacacaacatcgtgatgaaattttgctgatacaagacattttcaatgccccgaagcagctccccaaaaaagggattccggatatcaggcacaaggaccccaattgttttactggtcttcttaatcatccgctgagcaaagtaatcgggctcataatttaattcatcccgggccgcttccaccttagcaaccgtcgccgcactaaacttatcaccatgcccgtttaaaatttgtgacacggtcgcaattgagcgttctgcaaggcgcgcgacatctttgattgtgactgccttatttttcatgggcttctcctccgtaaaattaactcttgcattattgtagcctagaacgccgaattttcctaaccgaatctcaaaaatatttagtacacctataagtatatctatatagtgtgcaagccgataatttatccatatcaagtcttcattttctcctcctctgaaaacaaacagtaaaaactttccaggtagttattctaaaaccacatgacaaaaaagcccgcgctcatcatgagcgcgggctcccttaattcacaaagggctatttttcagtaccttggccgtcccattcacgttcaatgattgcctttaattcactgattaaaggttcgcgtgggttagcggtcgtgcattggtcttcataggccagttcggctaattcgtcgacggtggcgtcaaagtgcttcttttcgacccggttagctttcaaggataaggtcacatccattgaatgagccaagtcaatgtaagctttaactaagctttctttgagttcttcgtcggtcttgcctggtaaccctaaggcccgggcaatgttggcatagtcggctaaggcagtattgtggttgtacttcggccacattgctaacttcgttgggatttcagcattgtaacgaacgacttgcggataagtgattgcaattgccaatccgtgtggtaagttgaattccccgcctaatttatgggcgatcgagtggttgatacccaagaaggcattggcaaaggccatcccagctaacgttgaggcattgtgcatcttctcacgagccatcttgtcgccatcataagaagctttcaagtacttgaaggctaattgcaaggcttgaattgaccagccgcgtgtgaagtcagaagccatcgttgaaacgtaggcttcggttgcgtgggtaatcacgtcgagacccgtccaagccgtcgttcgctttggcaccgtttcaacaaactgtgggtcaacaatcgcaatatctggttgcattgcgtagtccgtaatcgggtacttgacgtgcgtcttggagtccgtaataaccgcgtatggcgttacctcagaaccagtcccagaagtcgttggaatcccaatataagttactttttcagatactggtactttgtacgtccgcttccggatatccaagaacttctgtttagcacctaagaaggaagcttctgggtgttcatagaagagccacatccccttagcggcgtccattgcagaaccaccaccgagtgcaatgattgtatctggcttaaaggccttcatccgggcaacccctttgtagaccgtgtcagtcgacgggttcggttcaacttctgagaagatgtcgatatcgaccggatcagtccgcttgttcaagaccgccgttacgcggtcagcatacccaaattcaaccatcccaggatcacaaactaggaaaaccttcttaatcccggccatgtgttccaagtagcgaacggaattgcgttcgaagtagactttgggaggcattttgacccattgcatgttattacgccgttttgccacagttttgatattaatcagatccatatccgtaacgttatgagaaatcgagttgccaccatatgatcccgtgcccagagttaatgaaggcgccatgttattgtagatgttacctaacccaccaactgaagatggcgtgttaactaagatccggcaagctggcatttgtaggccaaattctttgaccaacgcatcatcggtcgtatgaatcccagcagtatggcctaaaccaccatagtgaagtaattcattagcccgcttgaaggccgcttcatgtgagtctgctttgtaaacggtcagaactggtgataatttttcgccggatagtgggtacttgataccgacaccgttaatctccgcaatcaagacccggcaatccttagcgacatctttcaagccagccatttgtgcgatttgataagcagtctgaccagcaactggaccacgaactgtgtgccggttaggatcaatgacagcatcactcaaggcttgaacatctttaggtttaacgtagtagcaacctaagcgaataaattcagctttaacttcagcataaatttctttgtcaataatggcactattttcagaagcacaaatcatcccattatcaaacgtcttcgataaaacaatatcgttaaccgcctgcttaatgtcagctgttttttcaacataagttggaccgttaccaggaccaacacccagtgctggtttacctgatgagtaagcggccgtcaccatacttggaccaccggtagctaagatcgtcgcaacatccgtatggtgcatcaaggcgtcggttgcttcaatgcttgggtgttcgatgtataaaacagcatcagctggaccaccagcagctttaatcgcttcccgcatcacatcagcagccgcagaactacatttctgagcttgaggatggaaaccaaagacgatcgtgttacgaccttttaatgaaatcaacgtcttgaaaaccgttgttgaagttggattcgttacgggtgtaaccccggctacgataccaactggttcagcaatttccattagttgctcttcatcgtcttctttaatgacgccgactgtcttatcatggcgcatgctgttccagatatattcgctggcgtagatgttcttaatcgccttatcttcaacaacaccccgaccggtttcctcaaccgccaacttggctaacttcatatgattgtccagtgcggcaaccgcaaccttttcacataaatcatcgatttgtgcttgggtatatgacttcaaaatagctaatgctttcttagaacgttgaactaattgatcaacttcgtcagtaactttgcttgtttgatttttttctgtcttaatcatgaagtgcttcctccgttcaattcctttgtgaattaatttacaaacttcattatagccgtccttgctcataatgcaacaataaatctaaaaaatatttaataacgtcaaaacggcaagcttataaacgcctgtatatcagtacttacgtccaatataaaaatcccaatcgttaagttcattaatgaacaattaaaaccaaaaaacaaccgcaagctcctcattagccatgatgagcttgcggttgttaaaatttcatcagcttggatcttaatccctgtcccgagtcttgattaccgaacaacgataactgaaataggtgcttttcgggctaaacgcggaccaattgccccagcaatcttagaatgtggaaattcggtatcggcaccggtcactaatagatctggtttaaattctggaataacttgctctaaaatgacgtcatccacatcaccgccttcatagacaagcggctctacttgattaacgcctcgttgttcagcaagctgaacatactcggcaacaacatcttcaacgtgtttccgtttagcctggatcttcgacggtgttaaggaatcaaagatattgatatcttcgctttccagcaccgaacaaattcccaacggaacatcatagtcgtgggccaaagtcgttgcgtatcgaaacgcacgttctgaagaggtattatcgtcctcatcaacggttagtaaaattcgccgatagacaagtggctcttgcattttttgattttccatagttaatctcctcattgaagtgaattgatattgaccactgccattataccagtttcagaattcaaacgggaccatttctcacacgactcaatcataagccgttttctatcaaacagcgctctcaataattaagagtagcttttaacgtacgattccagccaccagttagcgtgacaccactatccccattactccggtaaggctttcaacgtctgcttcaaccaattcacatagtagtcttctcgtccgatcgcatgttgtaagatcaaatagtgaccataatgttgcttagcagctttagcttgcgggaaaacggtcgccaatcgctgttgtaagtgtgctaacttagctgtgtgcagggtgagctgttcctgtaacatcgctagtaggcgtggatcacgatccgtttgaataaagtatagttttaaaataaattcatctttcgtagcggttaagtctggtgtaccgacactgatccactcatgtaatagctgccgaccagttgcggtgatgtggtagagtttcttctcaagtttttcgccactgaccgtaatttcatgcgtgacgtaaccttgttcttctagtcgcttcaattgcggataaatctgactatgctgcgcttgccagaattcaccgatctcgtcatcaaaggctttagttagatcatagcccgttaatggttgctggtttaataaccctagaataataaattgtaacttgtttttttgcgccattggaaattcctccttgacgattccttgataacagtatacactagccttgttgtttaaaacatgtaataaattacatgattaaaatgacatattagatataaggaaggtaattctaatgacaaaaacttttaaaacacttgatgactttctcggtactcactttatctacacttatgataatggctgggaatacgagtggtacgccaagaacgaccacaccgttgattaccgaatccatggtgggatggtcgccggtcgttgggtcactgatcaaaaagctgacatcgtcatgttgaccgaaggcatttacaaaatttcttggaccgaaccaactgggactgacgttgcactaaacttcatgccgaacgagaagaagctacacggtaccatcttcttcccaaagtgggttgaagaacatcctgaaatcaccgttacttaccaaaacgaacacatcgatttaatggaacaatctcgtgagaagtacgccacttatccaaaattagttgtgcctgaattcgccaatattacttacatggacgacgccggccaaaacaatgaagacgtgatcagtgaagcgccttacaaggaaatgccgaacgatattcgcaacggcaagtactttgatgaaaactaccatcgcgtaaacaagtaatgtttcacgtgaaacattgtgctgtaaaaattggataattaaccgtctacgccccatttaaagatgactaattatcttagaaacgctaaagtacaataacactcaaaaaggccttcataaatgctatggcatttatgaaggcctttcacattgctaactcatttaggcttccgttacatccagtgcaacctgtcccagaccggcgtcaaagtcagcctgccagtgtcccgtggtcaaatgtggtggtaatacaaacgttcctgaggagacgcgttgaccagccgtcagcgttttgccctgagccgcaagcttgccgactaaccacttcaatgactcaagcggattccccaacacttcactcgcctgaccagttttaaccgtttccccatcatggactagcgtacactttggcgttgccactgcgtcagctgaagcgaataactcggcagtctcccgttcagtcccatataccactagtccaccgactgcggcgtccgcgactactaaatttttaggtaaatcggggaaccagtcagcaaaacgtgaatctggcaattcaagtcccggcgcaacggtcgttttttgccataaatcggtcaatgaatcgctggttgacaggtcttctttagccttaaagaccaactcaacttcgacgagtgggtccattaattgcccgcgtcgaaccatggttggtgccgccaagaagtgatccgcaacctgggcaccgtacagcggtgtgtgcgcatcaaacatcttttgggtttccgcactcgttagcgagaccttgtagccaccaactggctgctgctttaaggccgttaatgcggcttggactcgatacgcagcgtcttcgtcagcgacactacttgtaaaatcagccattgttaacgcatgctgagtctgataggccgtaaatagttgttgtgcaacttgagtttctgtttctgtggtggtagttgtcatgataaaacctccattatgtgtttgtggttactgttagcctactatgtgtttgtaatgcggcgtgttgccctcatcacaattaatccagttgtcgcttcattattgggacgtattcagtacgccaacttaatcacacccgcgcctgaaatacgaattgttaagactacgggtcataaataccaatcaggttaaaactatgtgtgcttaaacgtataaattgcaagttactaaaactatgtgttaatcgatacacgtggtattgtatgtgattggcccgaagtactcagtattgctatgtgttttgatttcttggttgacctatgtgttactcgaggagcaagtccccgtgcgactagttaccattgcccacacttgttggtaactagccacctgaatgtccgattccatactcctcaccacctttaaatgaataaaaaacgtcctttaactaactcctacgagttaattaaaggacgtccagaacgggttaccacctttattcgcgactacttcacaatagtcaccttagtacgtacagcaattgcgatacgccggtactttaatgggtaccatccagcaccatctccacgaatttcgaggcgcaactccaaggtgatctatgttaagtggtattgactgccttgcaccaatccgcagctcgctaactaaccagcttagcaccgttccttatcacggtttttaatctaaatttaattaatgattagattctagcgccagattatcacgatgtcaaccttaaaattaaaaataaattagattaattaaattttcgttcattagccgtgacatccactaatgccacgtactgttcagtatgcgtgtcacgcaacgtataatttggcgggagtgcgtccgcatccgctttaacaatttgaaacccgacttgcgcataaaatcgcagcgcattttcgttggccatcacacacttcaacgtgagtggttcggttgcatactggcgcatttctgtcagtagccgctcaccaactttcaagtggcggaaatctggggccacaaaaagcagatgaatgaagttagccagccggtacaatgaacaaaagccagcccgctgaccatcaatccacgcgaccagcacgaattcaccacgactgtcgttgttaaagtcttgtagttgtggatcagtgacccatggaaaatcttgctggcggtccactaaataaatttcagctaacgctgcttgatccgcggccgttgccggtttaatctcaattcgtttggtcatcctgcgccctcccccatttaatgattctcattatgacgttagttgttgagaatttcaaacattaatcgccttaatctattcgtcaaagctagctttcaactactgacaagcgttataatgttaggcaatactttcaccaaatgaaagcgggggaaaaatgaaaaccgcaattgtaacggatagcgcaagctacctctcagcggccgatgttgaaaagtatcatattcacgtcgtcccaattactgttatttttggtcaccaaacctacttagaaaacgtcgaaataacgtccaaagaattttatgaacgaatgcgtaccgcgcctgagttaccaacgaccactcagattacccttggtcagatgcaaacgacttacgatcagctggcagaagcgggttacgatgctgtgatcagtatccatctttcttctggcattaccagctttattactaatctcgaaagttacctgccgaacgtgaccaacatcaaggtctatccgttcgattcactaattacggctggcggcgaagcttacatggtcttgttagctgctaagctggtcgctgaaggatactcacccgaacaagtcattgcccagctcgaaaagattcgcgagaccaccggcgtatattttgttgtcgataatctcagtcacttggttcggactggtcggctctcaaacgcttctggactcgttggcaacctcttacgcattaaacccgttctgacctttcaagatggcaagatcgtcgctattcaaaaagaacgaacgatgcggcgggcatacgcagccatcaaagccaagctggctgctgagattgctgccgttgactatccacttcgcgtcacaatcgaaaatggcaacaatccgaaactccaagccgaatggacagctgacttgaaggctagctttcctgatctcaccatcgatgaaggcgagattggtcccgtcgttggggttcacgttggagaaggcgtcatgggactgatttgggcccgtgactgggaaaagtggtccgtttaagttaacgaccactaacctcgataacttataatgacaatcaaaaacaacttttgtccctcgcatcaagctgaggccaaaagttgtttttttcagtgtcttattttcgttttttaccttttttctttttcttaccctttttctgctttgcattaggctgttcggtcgatttagcgatcaactttcgtgccttcttgatcaacttagcccgttgcttagtatccaattgttcccacaaggtcattagttcagagtcaacggcgggggttggcgtaaccgccactggaatcggtaccgcttcgggggttgccgccgttgcaatgtcagtcgtgcctaacaaccaatctggcgacacgttcagtaccgttgctaacgccgtgaccttatcatgttttgccacgtacttactgcttaaccattgactgattgatgaacggccaattcccgtttgtttagctaactgagcagatgttatgttcgcttgttgcatcgcttcttttaatcgttctgcaaatattcccatcacattaccctcctagtgcagcggatcccatgcgggtaaccgctgtgcacgttcattaagcagtgcctgaaattctggtgccaagaaacgcttgtgaacaactacttcatagacgtactcatcgaaccaatcctggctcatcacgaagtacccctgatcacctacttgcccaccccaactattttcgaccttccacttagttggcgtatcggccactaagtcaacgccggttaacgtcatggcgtggctaacctcaccttcacccgttaatagccgttgtgccttagtcagatgatcattggttccgaataacttgccagtttcaaataaatgggcatccaagtaccccgtcttccgatccatctgtcgcaatacgtcgttaccaaaccaaaccgtttcaccagcctgtaactgttgcacagcaacgtccgtcagcacacccatatcaaggttcaaaaattcgatgggcttgccaccaatcacgttatcctcgtcgggcagactataaagtcgattaaacggcttatccggtgaattagtaacgaccacgtaatcatccagatcagtttcaaagtagtcgcgatagaattgctggggcgtcaaattagccgtgcgatgatactgttgctcatcatcacgatattccaaatcaaagctcatcggtggttcaccaaatgagtacgctgtcatccgatagaccgcttgcaacattgatttctcgagtgattgtagctcagcctcacttgcaccatccatcacgaattgccggagttttaagccatctttacgaagttgccgtgataaactggcttgaaacgccgtcgtattatcagtgttgaatgactctggcatcacactagccggaacgacgccatacttttgaactaagctggccgccatcgcccactgaccaccatcttcacccggattagcaaataagaactgaacgagccggtcatcgattggctgacgcgccgtttgctcaacattccgataaaagatattagcccgttcaatcttatcccagaaaaataaatagttttgtgacaactcaaaatctttgacgtgatagcgggtcgcaaacttatgccggagcgtgtttaataatgaaaactcccagcaacgaccgctgtgcttctgattactgaccttacccgttggaacttcgacagaaaaagtccgtgctaagcgactcgcagcttgattatcaaagcttgcagcctcaatcccattcctcgtaatcgctcgtgtcaatactggtgccattcgatcctgtgcatgcgttgtccgtaaagcggcaagtgcatcctgtgttagttcagttgccatatttaccagcctccatcgtgatacttgccattattttaggcttattgaccattaaattcaatttagatgctacattttgtttgcttttctgaacaaaattagtcactttaactacccgatgttgttcgtcctgtgaagaatgactaatcgagctagttcgcccacctttcagcacgtgaatgcaaaaaaaagcgcgctcactaaaacgagtcgcgcttgcttctattcagtaactaatcgaattaatattgtggcgcttggttttactcgagtcccaaaacggcactttgaccacgcctaacactttgttggccgggacaaatccccagtaacgactatcatttgacaccgaccgatgatcacccaacacaaagtatgaattcttagggaccttagtcgttttcagattccaactataccgattctctagcgtacttagatcccaatttgtcgttccttgcgtccgctcatattgactgatgaatttctgcgggacaagtttcccattgacatagagtcgaccatcttcagatttaactgtatcgccaggcattccgataacgcgtttgacatatttgactgtcttggagcgtgcgtctggatcaacctgataggcgttgaaaacaataacactgaggtgccgaatcttagccgtcttaaccacggcgacgcgctcattgtcatctaagttaggttccattgacggtccgtccacccgcaccatcgtaaaaataaagtgccggattaccatggcaacgagtaaccccaccacgattggtagtacccagctcataatactcttaaaagttttcatcaaacgttctcccttaccccgctctaacttccaatcattatagtccaatcagcccggcttgtctggtattggtgacctgtatttacaaaattataatcgaatacatccagcccaactgagctgatcgttaatatccatttatctcagaacgaccagggaccggttagtatcgatcaaccaaaataagccggccccttagcgattgctaaaaggtcggcttatgaagttgccgtattcacgatttaacccacgcttgcttggctaaccgcttctcagtatgctagccgacgtgactgccaattagtctttaactttggcaattcgcccctgctgaatataaacactcagaatcgcaatatcagcgggattaacaccactgatccgtgaagcttgcgcgatggttgtcggttgaatcttcttcagcttctgatgtgcctcagttgccaacccgtcgattgcatcgtaatcgatccggtctggaatctttttggcttccatcttcttcaaccggtcgacacgttcctccgctttttggatataaccggcatacttgatctgaatttcaacttgttcaataatatgccgttctagtggttcgggggctgctgggataaatttcattaagtcagcgtattgtacttctggccgctttaagaaatctgctgccaacacaccgtccttcaattcaccagagttatgcgcacgtaagaacgcgttgacctcatcattaggtttgattctgattttgcctaatcggtcaagttcatccttgattgcttggcgcttagcctcaaatgccgcataccgttcatcatcgatcaagcccaactcacggcccttatctgtcaatcgtaagtcagcattatcgtgccgtaagatcaaccgatattcggcacgactcgttagtaaacgataaggttcattggtgcccttggtaactaagtcatcaatcatgaccccaatataagcgtcgctacgcttcaaggtgaactgaccgcgatcaagagcccgtaaaccagcgttgataccggcaattagtccttgcccagcggcttcttcataacccgaagtcccgttcgtttgaccagccgtataaaggttcttgaccagtttggtttccaacgttgcctttaattggtaaggggccaccacgtcatattcaatggcataacctggccgcatcatttcagcgtcttcgagacccttaatggaatgtagaatccgctgttgcacttcttccggcatcgacgttgaaaggccctgtacgtaccattcatccgtattccgaccttctggttccaagaacagttggtgtcgtttcttatctgcgaatcgcacgatcttatcttcgatcgatgggcagtaccgtggcccgaccccttcaatcacacccgtaaacattggtgctcgatcaaggttctcacgaatgatcttatgagtcgtctcattcgtataagttaaccagcaagataattgatgctttagatcaatgtagtcagcatctttcgtttcaaaactaaaatgatgtggttcaggatcgccaggttgttcttccgtcacactgtaatcgatcgtattaccatcgactcgtggtggtgtcccggtcttaaaccgttccaagttaaatccaagtcgttccagatcgccagataacttcatcgctggttgcgagttattgggacccgaagaatacatgagctcaccaatgatgatcttaccgcgagccgcagtcccagttgtcaaaacaacgctcttggcactatagcgcgcgcccgtattcgtgatgacacccttgcagacgccatcttcaacgatcaaaccgtcgacgattccttgccgtaaagttaagttgggttcccgttcgatggtgtgcttcatctcagcatggtaagcatgcttatcagcttgggcccgcaacgcccgaacagctgggcctttacccgtattgagcatccgcatctgaacgtaagtcttatcaatgttacggcccatttcaccgcccaaagcatcaatctcacggacgacaattcctttagccggaccaccaaccgatggattacatggcataaaggccaccatgtctaggttgatcgtcattaaaagcgtccggttacccatccgggcagcggctaatgctgcttcagaaccggcatggccagcaccaacgacgatgacatcatagtcgcggcctgggtactgctttacttctgtcattacaatttcctcctaccactacttacccagacagaactgactaaatagctggtctaataattcatcttcatagctatccccggtaatttgaccaaggaattcccagcaacgggtcatatcgatttgaaccaaatcaactggcatacctgccgcaagccccgtttgaacatcttgtagcgcttgcttagcttgatttaacaaaccgatgtggcgcgcgttggtcaccatcacgttattctggctactttcgatcccctcgttgaagaacatcttagcaatccgttgttcaagttgcgtgacaccactttgttgtaagaccgacatacttaaaacgtcgctcaagtcgactagttgcgctaattcagcttgatcaagctgggcaggtaaatcagtcttgttcaagataacgattcgttttgactggtccgtttcttgcaacaactcccgatcttcggccgtcaatggctggctattatccagtactagtaagactaagtccgcggctccgatggctttgcggctccgctcaaccccaatcttttcgaccttatcttcagtgtcccgaattcctgccgtatcgacgagtttcaatggcactccacgaacattgacgtattcttcaatcacatcgcgggtcgtcccggcaacatccgtcacaatagctttgtcttcatgcaacaggtggttcagcagactggatttaccgacattgggacgcccaatgatcgccgttgccaaaccttcgcgtaagaccttaccttgcttagccgtcgctaacagttgattaatgctttgggcgacctcggtagccttctccttcagcatcttggtggtcattgtttcaaccgcgtcatactctggataatcaatattgacctccacttgggctaacacgtccaaaatatcttgccgtaaatgtcggatcaacttagataaatcaccatctaattggtttagagcgactttcatagacttatccgtcttagcacgaatcagatccatgactgcttccgcctgtgacaagtccagccgaccgttcaagaatgcccgtttagtgaactcaccaggttccgccattcgcgcaccgtggctcaagatcaattgtagaatttcattcgtcgccacgagtcccccgtgacagttgatttcaaccacgtcttcgcgcgtataggttttaggggcgcgcatcacggtcgccatgacttcatcgacttcctgatgggtatcaggatcaacaatatggccatagttgatcgtgtgggattgcacccgactgagatccttacctttaaaaatctgggtcactacgttaaacgtttggtccccactaatccgaataattgaaataccaccctcaccaggcggcgttgaaattgccgcgatcgtgtcaaattctgtggtcgttggcataccatcatgtcctttcttgtcagcgtttcatcgcctaataccataccaaatttacttacaattagttaataatatgtcctaaaatgcagaaaaaaagcgcctagtccacgccaccttaaagcgtggataaagcactttgactactttatctaaaagataagaatgattaacacctactataatagctcacccggagtttgtcaaacgcctgtttgcgttactttgaataaactatttacgaatcgcgacaaccacggcccggtgcggatcgcggccttctgaaaatgtcgtcacatggtgattattcgctaactcagcgtgaattaatttccgttcaaacgacggcatcgggtccaagaaaacttgtttgcccgtcgcaatcacttctcgagccgtactttcggctaaccgcttaagtgtcgcggtccggcgttcccggtaatcatccacatccagcaccacgttcacgtgtgacgcaccgtgatgattcatataaacttgcgccaaatcctgcagtgcattgatcgttcggccgtgcttgccaatcagcaaaccctgcttagccgtatcgaagttcaatgtcgcatagcggttgccgaagtcgacgtcaagatccgccgtgacacctaactctttgaccaccgcaagcaagtaatcacacagcgcccgcactgcggtctcgttagctgcttggcgcgccgcaatttcagcgggtgtccgcggcgtctggctctgatcagtagtcactgttttagttttactagtggtcaccggtttagctcggtcagtatcatcgataaccgggacggtagtaaccgcaaccgatgcgggtttagccacgtttttcgccttgctagtcgctgcttttgcggcactagtcgtagcctgactggttggtgcgggctttggtgcacgcatggttggctgcggcatagtcggtgctgtcgttgattcagcagccgctgactgttgcgctgtcgccgtagcagaagtcggcgtcgttgcaggtgctgcggaggctggcaccaccgttagccgtacttgggcgggttgcttacctagtcctagaaatcctttttttgcttcagcgataacttcaacttcaacttgatcgcgtgttcggtgcagttgttttagaccagccgcaattgcggccgcgacggtattaccttcaaatactgtcatgcttgaatcctcctcgttaaaaatcctgctttcattatagcattaccattcgccatgcgaacatctgagtatgaacacttaatgaacccttacaacgattaggacttcgaccgttctaccgccccggcaaactcagactagccaaacctagtgcttattatgtcaataaccaacctgatcatggcccgtttagagacgtgacccacatgctgcctatgctgaggtgtgtatttactaattgccactcgcgaccgtatcaaagttgcttttaaactcaataaaaccgattttccagtccgtaatggctaaaaaatcggttttattatgctaataatctaagtatttttagctgactaattctgacctactggtttgttactagaccagaccactatcaaattcaagccaggaacagtccgcctttcagtacgtgactgatcatatgacaaatcaaggctacccacacttagccctgattctcaataagccggactacccgacctgccgcacgggaacttgctcgtcaatgctggtcgtcttggctgcttgatgaacttgaacaccatgttggaagacatccttatcgtgctgaatgactcgaatatcttcgattgggttggcggtcattgcaataaagtctgcaaatttgccagcggaaatcgtcccgtattcatccgcaacatgcatcgcacgggcgcagttgatcgtagccgtatcgatagcttgtgcaggcgtcatacccgccttatcgacatagagctgcatttcgtatgctgattcatcttcaaagccattataaggcgttccagcatccgtccccatcgcgatgggaataccagccgccgcggctttagtgatacttgcaaagtgcttcttgatgttgacgatcaccttttcacgcgcccatgccggcacggtcttctcgccatatttataaatagcatacatcgcattcattgtcggtacgatcacggtgccgtgttgccgcatcatctcaattgtctcatcatcaatatcaaaggcgtgttcgacagtatcgacgccggcttgaaccgcttcttttaccccggcattcccctgcgcgtgagccgccaccgtcttgcctttatgatgggcctcagcaacggctgcttgaacttcttcaaaattaaactgaatatcatctggggtctcgccgtttcgaaggaccccaccggtaaccatcatcttgatattatcgacgcccattttaagggcctggcgaacaccttgaacgaccgcatccacaccatcgacttcgtggccgccatccgcaccatgaccacccgtaattgaaaaggcctggccagatgtcatcacgcgagggcccgcaatctttccttctcgttgcatctttgaaatcgcaacgtcaatatcatactgggcgccgacattgcggatataggttactccatggttcaccatatcctgcatgttgcggatcgcgtacatggtattatattcacgcgactccggatggcggtcttcctggccatcacgccaccaatatgtcggaatactggtaatatgcgtatgagcgttcatgatacctggcatgacgtattttccttgcatatctgtcgtttgttcagcaatcgtgtccggggtccccgtaccgaccgcgataatttttccggttgcgtcgtcaacggtcatgaattgattatcgataaaagtttgcttttctgaactgtagattgaggcattgatatagttggttttggtcataataatgacttcctttcattttggcaggtcgcaccccgttcattaacggtaacggaccatcattttcatcactgcattgttggttctctaactgactattcaccacgcctcaccacctttcatgacaaagtcttatttccaataagcatattgaagttgactggatgttccagaaaactcatcccactgcaagccaccaacatccttgctgaccaaaaatgcagaggaggcttggtaggtgggaatcacggcatcgagtttcatcaaccggcgatcggcttgcttttcataagtccagcgttgcgcggccgtgtatttcgccgtatcagatactttggccatcaacgcatcatacttcgcatctttccactgagtaaagttgatgctattcgaactctgcatcccatccaagaagttttgggcatccggataatccggcccccagccaactgtgacgaggtcgaagttccccgtaaaatcacgcgatacgtgggtcgcgtgtgggaccgcaacgatcttgatcgtcacgcctttcaaatacttttcggccacgccttggacgtattcagcgagtttcttctcagtatccgtatcgtcacatagaaagttcaaagtcacattttgcttaccaagttccttttgggccttctgccaatactgcttagcttgcttaatattagtcggtgacaagtttccaacttccttaacgaaatcctcaccagtagtcgggtcactcgcatagtttttcggcacaatgttcgtcgcggcttgtgagccatcttgcaagacatcttttgccaacgttttttgattaatgaccaggcttagcgcgtgccggaaattctcattggccgttacggacttcttactattgaaatagatgtaattattccggccagttttagtaaccgtcatttgactattattggcattattcttcacgtactgccccgaaatgttggtcacttggactgtgccagcgttgaagaggttctgcgccgtattatcatccttagtgaccgtgactttgatacgcttgatcttaacgttcttggcattccagtagtacttattcttaacgtaataccaactatcattagaacctttccaccccttaataacgtaggcgccgttcgccaccgttgtcgctgaatcactccctaacttcgacccgtatttctggactgccgccgtattgagcgggtaaaagctcgtaaactcataattcatataaggtaccggcttgcttaactttatggaaaatgtccgcttgttaatggccgtcacacctaacttactaacagccatttttccgttattgacggcatcaaagttcttgatgtaactaatagcatccaagttttgggacttcgttgccggattagcttgtcgccgcaacgccgtcacaaagtcttgtgaagtgattttggttccattttgccagcgcgcatttttacgaatcgtaaacgtataccgggtcttgttttcagttggtttgaccttcttctcgaccacccccgcaacaatcttattattcgcgtttttgcggtaaatcccttcaccagtctgcgtaattacagcaccgccgttcgtttcaatcgaagtcgtcggatcagtcgtcatcggttcgccaggaatcgtgatgcctaacgtcttattctgatcagccgtactggtcgtcttcgaagaattagagaccgctcccaaacagccggttaataataaggcgctcaccactcctataatgctatatgtatactttgcccgcatccctaatccctccattatgttttgatttaaccagatcagccggcgtcctacgacacaaaaagacgccccactaagctgttatgcttaaaaggacgtcttcacgcggtaccacctcatttgtgagccagttagactcaccacttacatacggccaaattcattgacgatatgttggtacgttatcgggtacacccggaaattgcttcacacaacttctcactagtaatcgacttttagctaccagttcagatcgcttttcatcatccgcgactcgctgtaactgactgataaccgactcctcgattgccgttcgcttaatctaattattttttaatgtgattcacatcttagcggtcatttttcaatttgtcaaatcttttttgggattttttcttccgccgagccactatgcttttggtcacgccgttctaatggcgattggtcaagtagccatctcaagctgcggcaggccgttaaaaacatgggctcaagctagtcattttatgcgcgacttgatttccagataattaccagtatccggtcgcttattacaatttctatattgcagtctgaccagtgggcgccgataactgtgcgttcgcatcctaacatctcggccagaccctatgttgactgtttggtaaaaatgatgcgagctcacaaaaaaagacccaccacacatggcaggtctacttgtatttaacgtttatgattacgaatcgcgcgctttctagctttttcaagcgttcgcttacgatcacgttcagcttgcttcttagcttcccgttcgcgattaatcttgaatgggttttgtaataacaaggtttgaccaacttggaacgcgttggagatcacccagtacaaggacaacgctgatggcacgttgatggccgtaatcaaaataatcacgggcatcaagtacgtcatggaagttgtcatcccgttttgttctggctgcgacttcatcgctaaccaggaactagcaaacgtaaagagcgccgctagaattggcaaaacgtagtacgggtccttgctacctaattgcagccataagaacgaaccggtcttcaaggcttgtgtccgccagattgcttggtacaacgcaatcaaaataggcaactgaactagtaatggcaacatgctggccattggatgcacaccatgcttggcatacaacttcttcatttccgcctggagcttttgctgagtttccatatcgcgtgacgaatacttcttttgtaaagccttcatctgcggttggacttcttgcatggctaccatgttgcgggtttggaagatcatcaatggcaagataatgacccggataatcaacgtgaagacgatgatcccaagaccataactatgaccaaacaagtttgataaccaaataatcgcccgtgagaagttcaagatgattaagccatcccaaaatccggtgctcttatccgtgattggggtattactacacccactcaaaactagtacgatcgctagtacggccagcattgccagtatttttctgtactttttcaaacgaatgtcctcactttaatcattgtccagcaggtgcgctagctttagcgcatggcttagataagctttggtttcggcttgcgacttaccggcaacggttggtcgggcaatgacgagaaagtccgcatcttgcttaagctgcggctttagctcggtgattgattgccgaatccggcgtttgacccaattacgtgcaacggcgtttccgatcttcttaccgaccgagataccgacgcgaaaatggggttgccccggtttttccaaaacgtaaatgacaaattgacgattggcatacgagttgcgggtctcaaaaacttgttggaactcagtttccttttttacccgatatgattttcgcataatccatctccatgtgtgcgctcaagctcttgagcgaattgctacacaactttacagccctaaacacctggtctaggactgtaaagaaaaagccactgattatcagtggcctatgcagacaatacttttctgcctcgttggcgtcgacgggctaacactttacggccattgctggtgctcatccgtttgcggaaaccatgtacacgttgacgatggcgcttctttggttggtaagttctcttcatcatgacacctccttctccataatgacatgaatcaattcgattaagtcgttattttcaaaacgcagtttacatctaaacgcatttcctgactactatagcatatttttatttgtttgaaaaccagtaaattaaatttctccgcagtatttcgggaacgaaaaattatttaattgcggatttctttgtggattgtccccaggtaactttccgttattcgcaatttacccacaagtttttcgacaaattaacgggttgttatttagttatccacaggacgtatttgttgtgtgtataactccaataaacgcttttattgcggctttagttttaaactcgtttttgtggataagtgctgttttataaaattcattcctagttttcgacaagctgtgtatattcaaatcccagcctgtgaattctcttaactttaacttgtccacttgtggaaaactctatatgttcatgctaaaatagaattacgttttttaagaaaaggggtatccacgtgctggaacgtaatgacttatggaatctcattaagttctctatggaacaagatctgtccaagatcacgtttcaaacgtttgtcgaaccggcaaaaccactccaactcgataaagctcaaatgacgatcgaagtcccaacacaacttcatcgtgactattgggagaaaaacttggccgcaaagttcacggacattgcgatgcaagcgactaacgagcagattcggccggtcatgataacggaagaagaacgtcagcaacttacgagagacaaggactcgcaagtgactaccggtaacgttgcgggacaacaaccaacaaccgcaactacccccacatttatgcgggaaacgaaactcaacccgaaatacacttttgatactttcgtgatcggtaagggcaatcaaatggcccatgccgctgcgttagttgtgtcggaagaacccggcacgatgtataatccgttgtttttctacgggggcgttggtctgggcaaaacccacctgatgcacgctatcggtaacaaattgttagaaaccgatccgactagtaacatcaaatacgtcactagcgaatctttcacgaatgaattaattaatgccattcaaactaaaaaacaggaagcattccgcgaagaatatcggaacgttgacctattattagtcgacgacattcaattttttgctaataaggaagcaacgcaagaagagttcttccatacatttaatgctttatatgaagacgataagcaaatcgtgcttacgtccgatcgcttaccgaacgaaattccgcaactccaagatcgcctagtttctaggttcaagtggggcttatccgttgatattaccccgcctgatctcgagacgcggattgctattttgcgcaataaagctgatcttgaaggaatcgagattcctgacgatacgttaagttatattgccggacagattgactcaaacgtccgggaactcgaaggcgccttagcgcgcgtgcaagcatactcgcgactgaataattcaccaattaccaccagtttagtggcggatgcgttgaagagtttgcaccttagtagtaagctatcagaggtctcgattcccgttattcaggaaaaggtcgccaagtatttccacgttacgatggccgaccttaagggaaagaaacgcaataaacaaatcgtcattccgcgccaaatcgctatgtatttatcacgtgaactgactgaaagctcactgccacgcatcggtaacgagtttggtggcaaggatcatacaactgtgatccacgcccatgataaaatcactaaagctcttaaaaccgacgccgaattacaaaaagccgtgggtgatttgactggtcagctcaaatcgtagtgtggataaaaaagaataacttgaaaagttttccacaacttatgcacatgtggaaaacttgataacaccgagtcttttctcggttttccacagtacccactgctctactattactacgaacttttattattaatatatatctagtgcccgtcgctagaataaagaggggattaacttatgaaattcacgatcaatcgatctgccttcatcaaagaattgaataacgtccaacgggccatttcttcaaaaacgactattccaattttgactggtcttaagttagacgttaatactgacgccattaccttaactggtagtgatgctgatatttctattgagaccaccattccagcaagcgatgacaacaatacgttagtcgttgaagatgccggttcaatcgttttacctgcccgtttctttagtgaaatcgtaaaaaaactaccagaagataccatgaccgttaacgtggtcgacgggttccaaacccaaattacttccggggccgcttcctttacgatcaatggcctagaccctgaaaactacccacacttaccagaaatcgatatgactaacaccattactttagccggtgatgtgttgaaagagctgattggtcaaactgttatcgctgtttccaaccaggaaagtcggccaatcctgactggggttcactttatcttagctaacggggagttcttagcggtcgcaaccgattcgcaccggctaagccaacgccggatcaaattaccggaagccaataacgccaattatgacgtgattattccaggtaagagtttgacagaactgtcccggatgattggtgatgataatcccgacgtccagatgcgcttatcagaaaaccaagtcttatttgtgctggggaatacgtcgttctattcgcgcttactcgaaggaaattatcctgacacgtcgcggttgattcctaaagaatccaatacgacagttgagatttcagcacccgcactttctgcagccatcgaacgggcgtccttgttatcacatgaaagccgcaataacgtggtacgcttctccgttaacccaacggacaaaacaattacgatttttggtaattcgccagacgttggggaagtaaccgaacaacttcagcccactgatttgtcaggtgacgaactcgaaatttcatttaacccggactacatgaaagaagcgttacgttcattcggacaagcgatgatcaagatttcattcacgatggcgttgcgcccattcacattagtgccaactgaagaaggcgaaaactttattcagttgattacgccagttcggacgttctaactagctgaataaatatacaattctgaataaaaggcccgcatttcacgttgaaatgcgggccttttttgacggctgtaacgagctgataacagggaaatggcttgctaatgacggtgatgtaacttttgaagtttttgcttatgcatattttgtttgttgcgcgttaattggcacgctgccatgcaaaattcctcttactaagagctactgatgtgatgaaccacgtttaggaaccttggctcgtcatattagtaagctcttgttcgtgactaatggtaacgactttaggcaaccttttaggtaaaaaaacaagatattttattaaaatccgcaaaatcagggaatttcagcaaatttacccccgggctagtatcccgatattaaaaaggcctaaatcggcttaaaatggctctgagtgcggctataaattgaattttcatcaaaaaacaagtataatataacctgttaggagtgtgtgtagcacgccagacagtcgtttaatagcttgtaatcagataggcaggtgacattgtgaaacagccaatagatatcaaaaccccatatatgacgttggggcaactcttaaaagaaacggccatcattggatcgggtggtcaggcgaagtggttcttaaaagaaacaaccgtgttagttaatggtgaaccagatgatcggcggggtcggaaactttatccaggcgatacgattgaagttgaagacaacgggtcattttttattcgctcaaatcaagaaacgactgattagatgtacttagaaaatttagtcttgcatgattttcggaactacgcggatttgaccattaatttcagtcagggcgttaatgtgttattgggtgagaacgctcaaggaaagacgaacctattagaagccatttatgtattggcgttaacgcgtagtcaccgtaccgctaatgataaagaattaattcggtggcaagccaccacggcaacgttgcaaggccggttacataaaagtaccggtgcggtccctctagaacttgaattgggacggcggggcaaacgagcgaaagtcaatcatcttgagcaagccaaactatcccaatacgtaggaaatttgaatgtgatcgtgtttgcaccggaagatttatccatcgttaaaggggcacccgcggttcgccgtcgttttatggatatggaatttggtcagatgagccctaaatacctctataacctaagtcagtaccgcacgattttaaaacagcgtaatcaatatttacggcaattaaatcggcaacaggctaaggataaggtctatttaggcgtcttgtctgaccaattagccgcgtttggcgcagaaatcatccataagcgactacaactgttgcaacaactcgagaagtgggcgcaggctgttcatagcgagatcacgcaaggacaggaacagttgacgtttcactatgttacccaagtacccactgccgaccaaacgtcggtcgatcatatttatcaaacgctacaagccttatatcagcagcaacaggccaaagaaatctttcaagggacgaccttattagggccccatcgcgatgatttgcaatttggcgtgaacggcaaaaatgtgcagacttttggctcccaaggtcaacagcgtacaaccgctttgtccgttaaacttgctgaaattgatctgatgaaagctgagacgggggagtacccggtcttattattagacgatgtcttatcagagttagacgctgcgcggcagacgcatctgctgacagcgatccaagataaagtgcagacctttttaaccacgccaagtcttgacggggtggcccgcaaattaattaacgcaccaaaagtatttgaagttagccatggcactttacatgaggaggaaccgcattgaccgaaaacgaaaaagaaaccaaacttgaacaagctcgcgaatacgatgctagtcaaattcaagttttggaaggtttagaagctgtccggaaacgtcccggaatgtatatcggtacgacgagtagccaaggactccaccatttagtttgggaaattgttgataacggaatcgatgaagccttagcagggttcgcaaacgtgatccacgtgaccgttgagaaggataatagtattacggttaccgataatggtcgtgggattcccgttgatattcaagaaaaaacgggtaaaccagcgcttgaaacggtttatacgattttgcatgccggtggtaaatttggcggtggcggttataaagtctccggtggtcttcacggggtcggggcttccgttgttaacgccttatcatcgacgctggacgtcaaagtaactcggaatggtcatgtttattacatggactttgagcgtgggaaggttaagacaccaatgaagattattggtgatgcgcctgatgatgctcatggtacggcggttcattttgttccggatcctgatattttccgggaaacgaccacctatgacattaatattttgacgactcggattcgcgaactcgctttcttaaataagggcttacggatcacgattcgggataaccgtcctgatgaacccactgaagatgactttctctacgaaggtgggattcgccactacgttgaatatctagataagaataagaccgttctattcccagaaccgatttatgtggaaggcgaacagaatggcattacggtggaagttgcgttgcaatataccgacgactaccacagtaatttgatgaccttcaccaacaatattcatacgtacgaaggtgggacccatgaagaagggttcaaacgagccttgacgcgggtcatcaatgactatgctcgtaagaataacttgttgaaggaaagcgatgcgaacttatcgggtgaagatgtccgtgaagggatgacggccgttgtcagtgttaagcatccggaccctcaatttgaaggtcaaacgaagacgaaacttggtaattccgatgctcgggcagccgttgaccggttattctcagaacactttagcaagtacttgatggaaaaccccagtgtggcccgtaaagtggtcgacaaagggttacttgcttccaaggcccgggtcgctgctaagcgtgcacgggaagttacgcggaaaaagagtggcttggaaatcagcaatttaccaggtaagctggcagacaacagtagtaaagaccctgagatcagtgaattgttcatcgtcgaaggggattctgccggtgggtcagctaagcagggtcgttcccggttgacgcaagcgattttaccgattcggggtaagattttgaacgttgaaaaggccagcattgataagatcttagccaatgaagaaatccggtcattgtttacggcaatgggcaccggcttcggtggtgactttgacttgagtaaagccaattaccacaagttgattatcatgactgatgccgatgtcgatggggcccatattcggaccttgttattgacgttgttctatcggtacatgcggccactagttgacgctggcttcgtatatatcgctcagccaccgttgtatcaagtccggcaaggtaaatttgtgaagtatattgattcggatgaagaattgagtgaggtcatggggcaattggcaccgtcaccgaagccagttgttcaacgatacaagggtcttggtgaaatggacgcggaacaattatgggaaacgaccatggatccagacaagcggcgcctattacgagttcgtgatgaggatgctgcggatgccgatggggtcttctcgatgttaatgggggaccaagttaaaccacggcgagaatttattgaagataatgccaagttcgtccaggatctggatgtttagtgtgtcagtttagtcatttcgacctaagagctgaggcgcagggcgtcaatcacacttagggacgtaatggcacggtggtcgtcttaatgacgacttttacttgagacatacaaagcttaattaagctttaatagcggcaaaacggatgaaggaggacgaatattttggctgattcagatttatcgaacaatcgtatttcggatgtgaacctttcaaagaccatgcgaacgtcattcttaagctacgccatgagtgttatcgtggcacgggcgctaccggacgtacgtgatgggttaaaaccagtgcaccggcggatcctttacggtatgagtgaattaggtgtgacaccggataagccgtataagaagtcggcccggatcgtcggggatgttatggggaagtatcatccccatggtgactccgcaatctatgaatcaatggtgcggatggcccaagattttagctatcgctacatgttagtggatggtcacgggaactttggctctgtcgatggtgatggggctgccgcgatgcggtataccgaagctcggatgagcaagattgcggtcgagatgctccgcgatattaacaaggataccgttgactggcaaccaaactatgatgatacggaacgggaaccagcagttttaccagcacgtttcccgaacttactcgttaatggtgccactgggatcgctgttgggatgacgaccaatattccgccgcataacttagcggaagtcatttcagcaatccatctgttgatggacaatcccgatgcaacggttgcggacttgatggaagttttacccggaccagattttccaactggtgggatcgtgatgggtaagtccggtattcggaaggcttaccagactggtcgtgggaacattattgttcgtgcgaaggttgatattcaagatcaaaagaatggtaagcaacgcattatcgtgaccgaactcccatacatggtcaacaaagctaaattgatcgaacggattgctggtctagctcgggacaaggaaattgaaggcatcactgatatcaatgatgaaagtgaccgtgaagggatgcggatcgtcattgatgttcggcgggatgccagcgcctcagttatcttgaataacctttacaagatgacgctgatgcagactaactttggttttaacatgttagccatcgttaagggtgcgcctaaagtcttgagtttaaagcaaatcttaatctactacttggaacaccaagaagacgtgattcggcggcggacgcaatttgacttgaagaaagcccaagcacgggctcatattcttgaaggtttgcggatcgcgcttgatcacattgatgaaatcattgcgatcattcgtcaatcacaaacgagtgaaattgccaagaatcaattgatggacaactacggcttgtctgataaacaggcccaagccattcttgatatgcggttagtccggttaactggtttggaacgcgaaaagatcgagagcgaataccaggacttgttgaaagccattgctgactacaaggaaatcttagctagcaaggatcgtattaaccaaattatttacgaagaattaatggaaattcaacgtaagtttggtgacaagcgccggaccgaattgatggtcggtgaagtcctcagtattgaagatgaagacttgatcgaagaagaagaagtagccgttactttaacgcacaatggctacatcaaacggttaccaacgactgaattcaagtcacaacaccgtggtggtcgtgggattcaagggatggacgtccatgatgatgactttattgaacatctactgacgacgtcgacccatgatgtcctactcttcttcactaacgcggggaaagtataccggatgaaggcttacgagattcctgaatacggtcggacggccaagggaatcccagtgattaacttactcggtgtcaactctggtgaaaagattcaggcggtcgttaacgtcacgggcgacgcgagcgcttctgataattacctgttcttcacaaccgttaaaggggtcgttaaacggacaccggttcaagaatttgccaatatccgtagcaatggtttgaaggccattacgctcaaggatgatgacgaattaatcggggttacgattacggacggtcaccaaaacgtgatcattgggacgcacgacggttacgccgtcagtttcgatgagaccacggtgcggtccatgggccggacagcttctggggttcgtgggattcgcttacgcgatgacgacttcgtgattggctttgacgtgttgaagcctgacagcaatgtcttcatcatcacggaaaaaggttatgggaaacaaacgccggccgccgactacccaattaagggtcgtggtggcaaaggaatcaagaccgctaacgtgactgaaaagaatggtcatttagctggcttgacgacggttgatggtcaagaagatatcatggtgatgacgaaccaaggggttatgattcgcttcaatatcgcgaccgtttcccaaactggacgggcaaccttaggtgttcgtctcatgcggttgggcgatgatggtcaagtcgcaacgatggccaaggtcgatccagagccagaagccgatgagactgctgcaacggatgcaacgacggaggcaccagttgacgatcaaaccgtcaaagcggatgtcacggcaaccgaaccaacaactgatgaaccaacgactgattcaaacgattcaaacgaataagccgacacaacaagcacagtagacaattttgtcgactgcgcttgtttttttgatctgagtccccgttttcagtagctacagatctggtggcaggaggggctgttcggtagcacggggagttcagttttaaccgcaaaaaagtcgatactcaaatgacaaagcgacggcggtagctaagaatagattgacgactgagtcttggccacacaccttgtcatgtttcaggaatagacagacccaattaagtgagattcggactactgcaattagtttgtggtgaccttgaggatttaatagtgatgcgtgttagcttaacgtcgacttgttctcaatgctgttgtgtgaaaatgtaagtggaagcgggaatttcagaaaaaaagaaatatttcccgggaaataaaatggaatagcgctcaattgacgtaattgattgatgtaacggattcaggatctttttgtaacagtcggccgcttcaacccttgcaacaaactgatttagatgctatactttaaattcgtgagtatctagcattagctagattactttccttgctcttcaaaaagaagggcctgaagtccataaggaggtgcaaatttcatgagtgaatcaaagaaatatgaaattacttacatcgtacgtcccgacatcgacgatgctgccaagacagctttagttgatcgtttcgacaaaatcttaactgataacggtgcgcaagtaatcgattcaaaagactggtcaaagcgtcgtttcgcatacgaaatcggtggctttaacgaaggtacttaccatatcgttaacttaacagcaactgacgatgctgctttaaacgaattcgaccgtctttcaaagattaatgatgacattttacgtcacatgatcgttaaacgcgaagactaatagacaaaattaatttcaagagaggagcacttctgcatgattaaccgtacaattcttgttggccgactaacaagagatccggaattacgttacacgaatggtggtgccgccgtcgcgacgttcactattgccgtaaaccgtcaattcacgaatcaaaatggggaacgtgaagcagatttcattagttgcgtcatttggcgtaaagctgctgaaaactttgcgaactttactcataaaggttcacttgttggtatcgatggccggattcaaacccggaactacgaaaaccaacaaggggtacgtgtttacgttacagaagttgtcgttgaaaacttctcattattagaatcacgggcagaatctgaacgtcatcaggctgctaatggtggtagtggtaataacaattacaacaatggtaattcgaattacaacaacaataataatgggtatagtaatcaaggccaaaatgcggctcctcaacaatcatcagcgaataacaataacccatttggtaatggtaatactggtaatgccagcagtgcggcaccatcaagcagtgctaacaacaataatcaggctgatccattcgctaacaatggcgatcaaattgatatctcggatgatgatttaccattctagtctaattgcttagacagataacgaggagggaaatatcaatggcacaacaaagaagaggtggccgtcgtcgtcgtaaagtcgacttcatcgccgcaaaccatatcgaatacatcgattataaagatactgacttattacgtcgtttcatttcagaacgtgggaagattttgccacgtcgtgtaacggggactagtgctaagaaccaacgttctttaactatcgccatcaagcgtgcacggatcatgggcttattagcctttgtatctgaagactaatttttagtcattcaaaaaccacagacttcggctctgtggtttttatttacccttaacttgaccagatagggtggtggccgttcgatgaagcgtttacggtgattgacacgaaacgctgaagcggacggtggtttgtgataaaatatagtcattactgagaaggcttgagggatttttaatatgaaaaagatcttttcgcgtgaaaaaattccatttttcctacaaaatcagcagttacggctcttagcgttggttatttttagcctgtcgttaattatgctcgtcactggttatttaatgaactggatttttgggaccgtcgtcctcatcttgattgtgatggctggggtgatctcttataatacgttgatcgagctcagttcgagtgccaacgaatatatctcggacttgtcgtatcgtattaagcgcggtgaacaagaggcgttgattcagatgccaattggggtgatgatttttaattctgatcagactatcgaatggatcaacccctatctccaacgctattttggggataaggacgtcttaggatatcgattggaagatattgagccaaccctggcagcgacgctgagcgcgcatcaagacgaacccgcgacgattcggtggcaagactaccagtttgatgtccgggtccagcagagcaccaatacggtctatatgatggatgtgaccaagtatgctgagctgacggatcaattcgaagacgaaaaactcgtgattggacaaatctttttggataattacgatgaaatcacccagtcgatgactgatacggatatttccaacctgaacaattacgtgaccaatgaattgtctaagtggacccagatgtttgggatgtacctgaagcgcttggatgatgatcacttcttcttgttgggctatgctagtagtttacgacgtgttgaagagaataaatttcgcattttagatcgaattcgggagtcgacttctaagcaaaatttcccactaacattgagtattgggattgcttatggtgaacggaacatgaacaatttggccgatttagcacagagtaacatggacctggccttagggcggggtggtgaccaagttgtggtgaagtctgaggacgaacctgctcgtttctacggtggtaaaaccaacccgatggaaaaacggacgcgggtccgggcccggatgatcagtcagacgttacaagagttaatgaatcaatctgaccagatctttgttcaggggcaccgccaaccagatatggatgccgttggggcctgtctcgggattcgccgaattgctgaaatgaatggtaaacagtgttggatcgtcttggatgagcaaaatgtgcattcagacattcagcgtttactggaccagttgaagtctgatgagaacatcgagtcagcgattatctcgccggaagaagcacttgagaaggccactgaccaaagtttattgattatggctgaccattctaagccaagtatttcaatgtcacaggccctttatgagcggctcgaaaatcgcgttatgattattgatcaccatcgacggggcgaagaatttccagaaaacccagttttggtttatattgaaccgtatgcttcgtcgacttgtgagctgattaccgagatgtttgaatatcaatcgcacgatgccgaaccaatcaataagattgaggcaaccgcaatgttgacaggaatcgttatcgatacgaagtcgttttcattacgatcaggatcgcggacgtttgatgctgctagttatctacgatcagccggtgcggactcgttactcgttcaacaatttatgaaggagaacgttgatagttatctacaacgcaatcatctgattgaaaccgttgaatttgttaaccaggatatggcattatgtgttggtgaagatgatcaggtctatgacccagtaacggcggctcaagctgctgattcactattatctatgtctggtgtcgacgcatcattcgtgattacacgtcgtgaagatggacgggtcggaatttcggcacgatcacttggcgagatcaacgtacaagtttatatggaaaaattgggtggtggcggtcatttatcgaatgccgcaacccagattgaagggcagtcagttgaagccgtcaaacaatcgttgattgatttgttaacggcaactgatgagccgaccacagaatctaattaggagtgagtctaaatgcaagttatttttttgaatgatgtccgtggtaagggcaagcggggccaaatcaagaatgtcccggatggttacgcacagaactttttaattaaaaagggattggccaaggaagccactaaagcggcaatcaatacgttgaaggctgaacagaagtctgaagcagcacgtgccgctgaggaattagccgaagctaagcaagtcaagacagttttggaagctgatgaaacggttgttgaattgaaggccaaagctggtactgatggtcggttgtttgggtcaattcctagcaaacaaattgcaacggcgttagctgaccaataccaagttaagcttgataaacgtaagatcgaattaccagaaccaattcgggtattaggttacacaaacgtgcctgttaagttacatccagaagtaacggcgaaaattcgcgtgcacgttgtcgaaaagtaaaaggacggatcacaaatgaacaacgatgtgctggatcaaaccccaccacaaaatattgaagctgaaaaggcagtcttgggggctattttcttaaacagtgatgccctcgtggaagcgatggagtttgtcgaagcgcaagatttctatcggcgcgcacatcagatcatttttgccagcatggtgactttaaatgaccgtgacgaggctattgatgcggtgaccgttagtgatttattaacggcccaaaatcaattggatgatgttggtgggatgagctacattgctgaactagctgggtccgtgccgactgcggctaacgctggctactatgcgaaaatcgtggcgcaaaaagcaacggtgcggcggttgatcaagacggccacggagattacgcaaaaggcctatacggaaaatgatgacgtgaccacgttattagatgacgcggaacgcgatatcatgaacgtgtctgaacagcgtaaccagagtgggtttaagtcgatttcagatgtgttgaacgcgtcgattgaagagattgaccgcttgtatcaaaatgacgatgacattactgggttaccgactggctttgcggagctggacaagatgaccgctggcttgcaaccagataacttgattatcttagctgctcgacctgccgttggtaagacggcctttgtcttgaacattgcccaaaatgtggcgaccaaaacggatacgacagtggccattttcagtttggaaatgggtgccgaatccttagtcaaccggatgctgtgtgcggaaggtagtattgacgctggccatttacgaacgggacaattgaacgaagaagagtgggaacacttggtggttgccatgggtagtttgtccaaagcgagcatctttattgatgatactcccggaatcaagatgtcagaaatccgggccaaaagtcgccgcttagcgaaagaacaaggtaacctcggcttgatcgtggtcgattatttacaattgatcgaaggtagtaatacggaaagtcggcaacaggaagtttccgaaatttcgcggcaaatgaagaaactggccaaggaactaggtgttccagtcattgccttatcacagctatctcgtggtgttgaacaacggcaagacaagcgaccggtgctgtccgatattcgtgaatcgggttcgatcgaacaagatgctgacatcgttgccttcctataccgggaagattattatgaccgcgaaggcggcgacgatgatgatggcggtaattttggtggcggcggtggtgactttaaaggcggtgatccgcgggacgacgatgcctccgaggatgtcggtgaagttgaagtaatcatcgaaaagaaccgtgctggggcgcggggaacggtcaaactattatttgtgaaaccatttaataagttctcctcagtctcttatgcgcaggatccgcaggcttaattggcgctaaacaataaatctgttatcaaatccctcttaaactaattaagggggattttttgtttatcacgtaccgcggacgtttgttttccgccaattgattgggctaatacaatcgattttgccgtgataatgatgagtcagagacacaaatgtccctgttattttaaataaaatttgctatgatgaaaagtagacagatttaataatggtggtgatggcgtggcacaaaagcaactcattaaaacgccgtggctaattgccgggcaatttatgaataacattggtatgagctttatttggccgttaacaacgatttacatgcacaatgtgttaggtaaatcgttgacggagactgggattgtcctgatgctcaattcagtcgccaacgttttggcaagtacgattggcgggcgtgtatttgaccgcgggaatccttatcacctgttactgatggggattacgttgaacggactcgcgaactttgccctgatcttttttcatggatggccgtggtatccgatattattagtcgtgaccgggtttgctagtggctggctaaacacgatgtttaacgctttggccgccagtgtgccccgtgctaaagtgcggcgcacgtttacgttgatgtacctcgctgccaatcttggagtcgtcttcggtacgatgctggttggtatcgtgtatagcatgggaatggccttactattctcaatgactacgagcctcttcgtgattttcttgattattgcattatttgaatacaatgtggactcgtcgaatgtgacgggggttgatccgcgccaagggcaagatgtgcacttgccacgggccaactttcacattgtttggaccttctttattagtttatttattatctggttgctgtacgagcagtgggtcagcaatttatccgtctacatgacgaatctagggatgccgctgcgaaattacagttttctatggacaatcaatgcaggtttactggtccttattcagagcattttaagtttgctaggggatcggattaagaatttatataaccagttcttcttcggcatgctgttcgtgggcttgtcatttctatcgcttgtgattgcacatgattacccacactttatctttgctatggttttattgacgattggtgaagccacttggtcaccggccatgccaacgctagtgagtcagttgtcaccagttagtgctaaggggcgttatcagggactagtacaagctttttgtgcgttagggcgctcgctaggaccgctatttggtggtgtgatcatcgacaattggtcttataaggtactgtttttgttggcatttgtggtcttattgatcgttttagcagttaatatcggcgtcgtccgccttaatttacgcaaagccgtcaattatatgaagacggacgttcagaccgatgtttcacgtgaaacaaaataattagagaagttggtggcagtagtgaaagtgatgcgaaaactaaaggctaaacgggtcgtgattaaagtcggaacaagcacgttagtttatccggatggatcgattaacttacgggcaatcgaccaattagcctttgtcattagtgcaatgcgacatcgtggccgtgaagttgtcttagtttcatcaggggcaatcggtgttggcttgaattatatgggactcaagcaacggccaaaagcaatccctgaacaacaggcgattgcggcgattgggcaaactgaattgatttcgatttacaaagagcgcttcgccatttatgaacaaaaaattggccagttattattaacgcgtgatatttttgtgtatcctaagagtcaccataatgtgttgaatacatttgaggcgctattaaaacaaaacgtggtcccaattgttaatgaaaatgatacggtcgcggtcgatgaattggatcatgaaaccaagtttggtgataacgatcaactatccgcaatcgtggccacgaatatcggggcggatctgctaatcatgctatccgacatcgatggcttttacgatggtaatcccaatgcggatgcccgagcccaattattagggcacattgagcaggttgatcagcatacttacgagctagctggtggtagtggcagtcggtttggtactggtgggatggtcactaagctaaaagcagcagaacggatgatcgatgcgaatggtcaaatgattttagccaatggtgcggatcccgcaattatttttcagattctagcaggcgaaccagtcggaacgctattcggttaagttgaggaggttatcaaaatggcagatttagaacagttgggtcaacaggctcaacaagctagctatgcgctggggttactttcaacggcgcaaaaaaatcaagtgttgaccgcaatggcaacggcgttaacgagccatcaagatgagatattggcagctaatgcgcaggatttagagaacccgcaagtaccagttaagtttgttgaccggctccggctaacagcagaccgcatccaggatatggcgaccggactcaaacaggtcgtgagtttgccagatccaattggaaatgtggaccgcgcgtggcgcaacgaggccgggttgatgattgccaaggaacgggtaccactaggtgttatcggcatgatttttgaagcgcgccccaatgtgacggtggatgcatcagcactgtgttttaaaaccggaaacgctgtaatcttacgtggtggtaaggaagcccttcactctaatcaagcacttgtccaagtcttacgtggtgcattacgggccgaagcggtcgatgagaatgcgattcaactgattacggatacgtcgcatgcgactgcggctaagttcatgcagctcactgattacgtggacgtcttaattccgcgcgggagcgcccgtttgattcaaacggtgttggctaaagcaacggtgcccgttattgaaacgggagccggtaattgtcacgtgtacgtggacaaagacgcgcaattacaaatggccaccgatatcgtgatcaacgggaaggttcagcggccatcggtttgcaacgccactgagaagcttctaattcatcgtgcggtcgcggccgattatttacctagcatgattcaggcgcttcgtgaacaaggcgtagaagtacgcggggatgccgcaactcaagccattgttcctgatgtggttccggcaacggatgcggactggggaacggaatataatgatttaattattgcggtgaaagttgttgattcagaagcagcggccattacgcacatcaatcgttacaatacccaacattccgaagcgattgtgacggataattatcaagctgggaagctcttccagcaacgggtcaacgcagcgtgtgtttatatcaatgcttccacccggtttacggatggctttgaatttgggtttggcgctgaaatcgggatttcaacgcagaagttacatgcccgcggtccgatgggattagcggaattaacatcttataaatacgtcattgatggcaatggtcagattcgccattgatgagcaagtatcgttattagtcagtatcggctaatagcgatttttttatggtcaatcacagacgcggcttgtggcgcgagtccgtagccgatattgacttctgagtttaaaattccaacatagctgggctatttttgagctcgcgcaccgggcgcttggaattaaaagcagcaaaccaatttcggcctgaatagtgaaggcacgataccatggtggcttagcgtgctgagcgaaacttttagttgacagatgtaaacttaaaagctaatcttatcttaattagtctttaatctaaggggaggaatcatgatgatgaacgcaggatcacaaaacgttatggtagtcgtgaaaaccagtaattaccggtttaccacggataacggaggcttaccgttgatgtgttgttgtcggcgccaatcgaagtatcgttgccagtaaccgacatcatcgttaagttaggagtcatcattcatgaaaaaaagagtatggatcagcagtattggtattgtagccctaggattagtcttaactggctgcggtagccagcagagtagtcagcagaagacgttgaacgtaacggcgacccagtcgattgcgaccgccgatcctaataaggccgacgatatcgctagtcaggccgctattgctcagtttatggaagggttgtacacgactaaccaaaaggggaaagtcgtgccggcaattgccaagaaagtcgtcaaaccgactaataatgggaagacctatacctttaacttacggcacaatgccaagtggtcgaatgggaaaaaggtcacggccgctgacttcgtttattccgtgcaacgccaggtcgatccgaataccaagtcacaggaagtcggccacgttgctgaaatcaagaatgcaacggcaatcacggctggtaagaaggcggtgaagactctaggcgtcaaagcgttgggcaagtataagttacaaattacgttgcaacagcgcgtgccgtatttcaactatcggttagccacagaaatctatccgttaaataaacaatttactgagaaatacgggaataagtatgggacatcgtcaaagcggaccctctctaacggtccctatgtcttgaagagctggaacgggacgaatgacacgtggaaatacgtgaagaacccgtattattatgatcgcaagcaggttcgaatcaagaatgttaaggtacagacggtcaagaataacagtacggccgagaacctcttccaaagcaatggcgttcaagttacccagattacgggtacccaggtatcggcggctgagcaagggtcactaaaaaaacagatgaagattacgaagctgaaccaactctacttcatgttgtggaaccagaagcgttcagcattgcagaatactgatttacggcgtgctgtgagttacgctttgaatcgccagtcattggttaagaacgttctcaaagacggctcagtagcggcgacgtcattagttcctgctggcaataccaagaacccgacaacggggaaagattttaatacggataccggaaatttgtatccatacagtccagcaaaggctaaaccgtattggcagaaggctcaggcgagcttaggaaagcaaaagttaaccctgcaattattgacgaacgataatgatattaataagtcggtggcagaatatattcaagctgcaattgagaaaaatcttagtggtgtcacggtcaatgtcaagtcagtaccactgacaaatgagatttcaaccttaagcaagggtgactttgactttgccacgttgtcgtggtcgagtgatttccaagatccagttgatttcttgaataaggcttcgataactaattctgtcaactttgggaagtttaacaatgcgaaatatgagcaattaatctcaacgattacggccgataagcagtcaactaaggcccgatatcagacgatgcagcaagcggctaagctagtcgctcagcaacagggggtcacaccaatttatcaaactgctgctgctcacttgatcagtaacaaggttggtggggttcacttcacattgttgagagacgccctttatcgctatgcttactggaagtaatcagtcagataaatattattaatttgatagaaatgtaattgaataaatcaactagcccgaaaaaacgcgttttttcgggctttttttgatgttttggcaaacggcgcaataaaacggataaccacgggcttaactgtgaatagttgtcctgaatcagtttgcagcgttctgggtgaccagtcataataatcgttatcttttaggggtttgtgccctgtttgaccactaagtaaggcgaccttatcaaggataggcaaacaccctgtcaccttcttataataagattaattttataagctgctcagttaatcacatagggggtgtgatgctttggttaaacaaactacggaaatgaatgatgcaagttacttatttaataccggcgcaggatttaatagtcaggattacttaggctgtcatttggccgcatctggtcgggcggtatttcgcgtctgggcgccgcatgctaaggcggtcggggttgttggcgattttaatgactggcaaccaagcgcactaaagttattaggggcgactgggatttggcaaggacaagttccgaacgttcatgcgggtcagttatacaagtttcagatcacaacaccaactggccaagtgcaactaaagattgacccgtttgcacaacagttcgaacgaaaaccgggggatgcggccgtagttgttgcgccgatgacgatgcgttggcacgatagtttgtggctagctcgccggaagaagtcgcgcgctgccaatcggccaattaacatttatgaggtgcacttaggttcgtggcgccgacatcttgatggtagctacgacacttatgcagaattagccgctgaactgattccctatgtgaaacgactgggttatacccacattgaattaatgcccgtgatggaacatttgctggatgcgtcgtgggggtaccagcaattagggtactttgcgccaaccagtcgtttcggcgatcgcgacagttttctcagctttgttgaccagtgtcatcaagcgaatatcggggtattcgttgattgggtaccgggtcactttattcgcaattatgatgcgttgtaccagtatgatggtacgccgacatttgaatacgctgatcctgagcgcgcggataaccgtcgttggggcgcgtggaattttgatctcggtaagacgcaggttcagagttttctgatttcaagcgccgaatattggctcgaccagtgtcatctagatggtttgcgagtggatgctgtctctaacatgttgtattgcgactatgatgaagggcgcgaagggcaggttaatcaatatggcgataatcgtaatctggaaggaattgcgttcttaaaaaagctgaacaccacgattttagcccaccatcccgatgtcttgatgattgcggaagaatcgtccgcctacccgcaggttacgggttcggtggccaatggcggattgggatttaactataagtggaacatggggtggatgcacgataccctggatttcttcatgatggatccgttatatcggcacgaccactttaatctactgacatttgcattcgtgtacatgtttgatgagcggtttatcctacccttctcacatgatgaagtcgtgcacggcaagaaatccctaatgcataagatgccgggggatcgctataatcagtttgctaatttgcggacgatgctaacttatatggctgccttcccgggaaaacaactgaattttatgggctcagagtggggtcagtttctagagtggcgggactggagcgcgctggaatgggttgacttaaaggatgatctcaaccatcggatgcaacagttcacaacgcaactgaacgccatctaccggcacaatcggccgttgtgggaacaggaccacgatcctgcggggattatttatacgcataccgatgaccccgatagttcaactatgggatttatccggcaagccaagcggaaatacagttttgtcgtggcggccttcaactttgtccccgtcgaacggcaaaattatcgaatcggcgtgccgtatcgtggccattacgaattattgctcaatactgaggcacaggcatttggcggcacgtggacgaaactagagacgacgtttacggcggtcgatgagccgtatcgggggcaaccagctagttttaccgtgaccttgccggcgatgggtgcattgttgattcgaccagttaaagtgatagggggagttaagcatgcaagatgaaatgttagggattattttagcgggcggtcagggcacccggcttggtaagttgacgaaggatacggctaagcccgccgtgccattcggcggtcgttatcgaattattgattttacactcagcaactgtgctaactcgggtgtgaataccgttggggttatcacgcaatatcaacccctagaactgaatgcacatattggtagcggtgcgagctggggctttgatagcttaaatggtggggtgacggttttacaaccatactcgtctagtgaaggtgagaagttctttcaagggacggcgcacgccatttatcaaaatattgaatatattgatcaacaagaccccaagtacctgctcgtcttatctggcgatcatatttataagatggattatgacgctatgctgaaatatcatcaggagaagaaggcttcgttgaccgttggggtgatccacgtgactaacgaagaagccaaacgctttggcatgatgaatacggatgcgacggatcgaatcattgagtttgaggaaaaaccggaacatcctaagagtgataaagcctcgatgggcatttatatcttcaattggccgactttgcgggattacttagttaagagttatgctaccgataagtcacttgaagactttggtaaaaatgtcattccatcatacctagccaataatgaatccgtttacgcttatgcttttaagggttactggcgagatgttggaacgattaagagcctgtggcaagccaatatggaattcctatcgccccataaccggttaaatatcggcgatcgttactggcgaatttactctaaagcagaggtgctaccaccgatgtttttgacggaaacgagccaggtcaataatgccatggtcgttgatagttgttacgttgcgggcgaaattgatcattcaatcttatcgcaacgcgtgtcagttgggatgggtagtcgcgtggttgacagtatgattatgcccggtgcaacgattggaaaaaatgtggtgattgaccacgcattgattggcgaagatgcagtgattggtgatgatgcccagattattggtacgactgataagattgcagttgttgggtatcacgaaacgatgggggtggaacaaccatgagacgtgaacaagtgagtgccattattaatttactggaaccaagtgacgcgttacaaccattgactgcagttcggccagttggcatgttaccctttggtggtcgttatcggttggttgattttcaattatcgagtgtcatcaatgcggggattcaaaatgtgatggtgacggtcccgcggtcagggcgttccgtggctgaccatttgcgtagcgggcgtgactggagcctgaacacaattcgcggcggcctattcttgtccccatacaatgacttgaaattagtggcgccagaaaagaaggccgcattactgcaccattactatgataattcgattcagtttctgaaatgcagccagagtgagtactcggtagtgatgagtactcgcaatgtcggtaatattgatttaaaggcgctactacggtatcacgaggaacgtaacagtcccgtgacggcggtttataagcgcgttgatccagctagtttgattcccgaaaatacaatcttacaattgactgctaagggagaagcaacggcggtcgttccgatgagcaaggccaagattagcccgaagacgaaacaagttgccaagagcatggctatttacttgatgagtacggtcgatttaatcgaattattgcagtcggccaatcaacggggtgacatgatcagcctagaggaattgatgcggcaagcagtcatccaacataacgctaatgcttttgaatatacgggctttcaggcgaatattcatgatatcaacagctactttgcggccaatatggccgttttggatgaagctaatttccgagcgttattctacagttcgcgccgtatttacaccaaggtcaaaaatgaaatcccgacgttctttgcgactggttcacagtgtcgtgatagtttatgtggtactgggggctatattgaagggcaacttgaccactccgtcatcttccgggacgtactgattaatcgtgatagccaagttaaaaatgccatcattatgcagggggcccggatcggtgccggttgtaagctagaaaacgtcattatcgataaagacgctgtaattggacccaacttagtgcttaaaggcacttcaacgacaccgttagtcatcagcaaagggcagcacgtctttcaacaagcggaggtggccgtacatgactagggtattattcgcggcggcagaagcggcccctttctataagactggcggtttgggtgacgttagtatggcgttgccgcgcgccttgcaagcagaaggaatcgagacgcgcgtcgtgattccgtattaccctcaccagatgccgaccgaatatcagcagcagttagtgccagtgacgcattttactgttcaagtgggtgaacgtgcaatgtattgcggtattaaaactctgacagtcgcgcacgttcagtattatctaattgataatttagattattttggccgggacggattgtatggttattgggatgatggtgaacgctttgccttctttcagatggcggtttgtgaaatgatggagcggatcgattatattccggatgttttacaactcaacgattggcatacggcgtttattcctgtcttgctagccgaaaagtactattggatcgaagcgtatcgtgatattaaaacggtgctgacgattcataatttacagtttcaaggtgtctatgatccgattattttggacagtctctttcgaatcggcactgagacatacaccgaagctggcgtggcgttttacgatcaagtgaattggctgaagggcggtattaactttgcagatgccgttaataccgtgtcaccgacctacgcacaagagatccagacaccagcttttggggaacgcctcgacggggtgctgcgtgccaatcggtacaaactgagtgggattcttaatggcattgatatgcaattatacgatcccgcaaccgacctggcactaacggcgaattattcggctaaagatttgaaacctaagcgtcagaataaacgtgccttacagcgccgattagggttgcctgtcaaaaacgtgccggtattggcagtcgtttctcggttaacgaagcaaaagggcatcgacctcttgttagatgcattgaatccattcttgcagcaacaagatgtgcaactcattgttttgggaacgggtgacccagcattggaacgcgcgttacgcacctatcagtcggcgtatccgcaaaaggtggtcgccgcgattcaatttgatacccagctggcccagcaaatctatgcgggcagtgacattttcctcatgccttctgcctttgaaccgtgtggcttgtcgcagatgatggcgatgcattacgggacgttaccaatcgtgcacgcggtcggtggattacgggacacggtcattccgtacaatcgctataccggtcagggaaccggctttagctttgacgactaccagccagcggtcctacgtaaaattatggttctagccgtgaccttatatcgacagcgaccactggtttggcggcagctgcaacaccaagcaatgacttgtgactttggctgggaatattctgcacagcagtaccgtgcgacttatcagaagctaatgcgttaggtttgatgggggtgtgaatttgaaattaacgtgtgcgcaatttaaaaaggattttttaagtgaaattgagactttgtattcaacatcgctgagtgacacctcgacgattgggcaatttattgcactgggacagctagtgcggcgctataacagtcagagttggacccgaacagctaaattttaccgtgatcatcatcagaaacaagtctattatttttccatcgagttcttgccgggacgcttgctcgcttctaatttgttgaatctcaacttattgacgacggtcaaaaaagggttaacggaattaggcctggactttgagacaatcagtcaggcggaacctgatccggcgcttggtaacgggggcttaggtcgcttggcagcgtgctatatggacgcgatggctagtttgaagattgccggcaacggtaacggcatccgctatcgttacggcttgttcaagcaagtcttcatggatggctatcaagtcgaattacccgacgattggctccatcatggcaacgtgtgggagacccggcgcgataacaagagctgcatcgtccagttcggcggcaatgtgtggttacaaccgcaagcggatggtagcttacaaccgcaatctgaaaatacggaagacgtgctagcggttccttacgacgttgggatcgtcgggtatcacaacgatattacgaacaccttgcgtttgtggtccgcggagttaccacctagtgcgacctattcttcgcaggatcagcgtgatcgaatcagtgagatcaccaaggtcttgtatcccgacgattctaattcggccgggcaacaactgcgattacgccaagaatactttttctcttctgcgggtgttcaaagtatcgtgcgtgatttttgtgcgacgcaccatggcatcaaattattaggcaaaaaggtcgcaattcacattaatgatacgcacccgacgttagtcatccctgaaatgatgcggctattaatggatgaacaccactgttcatgggaagtcgcgtggacgttaacgacgcaagtcatgagttacacgaaccatacgattttacaagaagccctcgagacttggccaatcgatatgtttaaaaacctgctacctcggatttatcagattattgcggaaatcgaccggcgctaccgggaacaacaaacgccgatttttggcaaagcgctcgttgatcagacggcgcctttaggcaacggacaagtacggatggcctacctagctgtgatcgggagtcacagtgtgaacggtgtcgcgccactgcatacggaattactgaaaacggatgtgttacggggcctgtatcaagtttatccggagcggtttaataataagacgaatggcattgcaacccgccggtgggttcaattggcgaaccagccgttagcacaactgattgatcagacgatcggaacggactggcggcgacaaccggatttattacagacactattaccgtatcaacaagatgaccactttttgtaccagttagggcaggttaaactgactaataaacaggctttagctgcgtacgttcagcgtactatggggatcaagattcgcaccgatgcgatttacgatgttcaaatcaaacggttgcatgcttataagcggcaactcctacacgtctttgaaatcttgcgcgagtattttgccattaaggatcatccgcaacagccagtcgtgccgcgcgtccacatttttggggcgaaggcggctcctagttatcactatgccaaggcgattatcaaactcattaatgtcgtcgctgacatggtgaatcaggacccggcgattggtgatcggttaaaggtcgtcttcattcccaactacggtgtctccattgccgaactgatcattcccgccgctgacgttagcgagcagatttcaacggcctctaaggaagcgtcagggactagtaacatgaaactgatggccaacggtgcgttatcattggcaacgtatgacggtgccaatatcgacattatgcaagcggcgggtgctgaaaatgaatacccgtttgggctcaaagtcaacgaagtgtacgactattatcatcgtggtaactaccatgccaccgatttttacaatgctgatcctgaattaaaacggctcttagatagtttggtcgatggcacgattccgggaattccaacggttggccgggagatctatgattcattactgcggtataacgatgagttctttgtcttagctgattaccgggcctacgtcatccaacagcagcagatcagtcatgattttcaaaatcaacccacttggcaacagcgctcgttagcgaacattgccgcttcgggacactttgccgcggacttagcagtggcgcggtatgccgacgatatttggcaagtgccccacgaacgactgaattaagaaaggaagggtgacggatgcaggtaacgtataactcatttttacccacgtataagacgccctttggtgccgtgacctgtcagacgcccgttcaattcacgctcagcgttcagacggtaacgccggttaaacagattgatttgtgtgtggcccatgatggtcagtgggacgacgaacaagccttaccgctacacccgattagtcccacgatgtacacgacgacgtttataccgacccaggttggcctgtacttttactattttcgaatcgaaacggcgaccacgactgcttattatggttgcgtagacggtggttatggtggcccgggtgtccaatacgtcctgcgtgagcatgttcaaatgtatcaattgacgattttaaaggcggtagagacgctgccaaaatggtatcgtgaaggggtcgcttatcagatcttcgttgaccgcttcaataatggcaacgcggatggccacgtcaatgcccccaagccgaatagctttatttatgggtagttaacggaccggccactatacgtacgggatgaacaccgagcgattttgcgctgggacttttacggtggcaacttgcggggcattattgctaagattccatatttacagcggctcggtgtgacaattatttatttgacgccgatttttgaagctagcagtaatcatcggtatgatacgggtgactatctgaaaatcgatccagtcgtcggcgatttgacagattttgatgacctggtcacggctttacaccaagctggcatgcggctgattttagacggcgtttttaaccatgtcggggtggattctaagtatttcaatcaagcgggccattacccaacggtcggtgcaacgcagtcgattacgagtccgtactattcgtggttcacgttcattcattatccccacgactatgatagctggtgggggattcgagatttgccgaccgtcgataaggacgacccgacataccgcgactttatctttggtaaacccgattcggtcatcgattactggacgcaacgcggggtggatggctggcgcctagatgtcgcggatgagttgccagacgatttcattgctggaattcgacggacgcttgaccgttacccagataaggttttgatcggtgaagtttgggaagatgcctctcataaattagcgtatgggatgcgccggcactacttagagggcggcggcttacaggctgtcatgaactatccgctccgccgcttgattatacgggttttaaacggtacgctaacgccagcggaatggtggcgcgaattaatgacgctcaaggaaaactatcccgctaccacgtttcattttaacttcaataacatcggcagccatgatacgcctagaatcctgaccatgttggctgaagatcgccaacgcctgcgcctggccgttcagttactcttgacccttccaggtgtaccatgcctatactacggtgatgaggcgctgatgatgggggggaaagatcccgataaccgggcattctatccgtggcaggatgcggatcaagcgcaagttcagtttgtcgctgactgggcgaattggcggcagcggcacccgtggttaaatacggcccactttatcccgttttacctggcggattatggcattggctacctttattggcaagctgatcagaccgtcatggtaatcgtcaatgtgactactgagccgcgaaccatgacgagtcacgatttaaagttgagtggtgtgccattgaagttagcgcaagcgattcaacactgccttgtcacgcagatgctaggtggtacacaattgcgccttattgaaaactttacctaatttttacaagaacttgatgattgttcgttcggttcagccgtatagtataattgtactttttaatagcaccccgctattgattatgtattacgaagtactcatcgatccttaatgagacgtaggaatattggtgcgtggctttccttgattggtcacgcatcttttttgcgctcataaacagaatgtctgcgttgttcagatgaggtgcttataataaaagtaaacactaacgctctttggtggtgattttaaatttacgccattatgaaggcagttagggtgtgggcaacgctggttattggccagtgactgattaattaggaggtaattggttgtatcaagcagtagtgttttttgatttggatggaacgttaatgcaggacgataagacggttgcaactagtagcgtgcgggcaatccagcaactacgagctaatcatatcttgcccgtcattgccacgggtcgcaacgtattcgaagttcaagacgtgatggcagcgacggggatcgattcgatcgtcagtgcgaatgggagttacgttgcgtaccaagggcagtttttgagtgcacacgaactggataaggatcttctgaccgatattactcactttgccaatcgtcaacagaatgcgctagcttattataataacgccggttttgcgttaagccatcgcgatgcattgacgactagcaattatcgggcgctcagacaaacggcccgggtgatacccaacttttatcaacatcaacatattaatttcttactgacgtttgattcgttgaacgcagcgcaatatcagcagcggtatcgaggccgactacactttgttcggaataatccacgggcgctggatactatgcaatggggcgtctccaaggcggttggaattcaggatatcttaaccaaggcgcatttaactaaggtaccgacctatgcgtttggtgatcaattaaatgatattgagatgttccgcatggtccagacaccgattgcaatgggcaatggtcatccgcgggtcaaacaactcgcgcgctacgtgaccgctgacaacatgcacgacgggatcgctaaaggattacgacattttgagttgatttgagaactggccgccagctgagtcttgatgaggcttcagtgagcaatgtacctgataggccggcgggattaataatcgattgaaacaaaataaaccggatttggtaaccatgacgtggtcactaaatccggtttatttgtgctgaatttaatcgaaatacgttattagtctagttgtgtcttgatattggcgagcgtgagctgagttgtatcggtaaagttgatatctgccgccgctaaaacggtcgggtcaccaataccgatggcggtttcgccagcacctttgatcgattgtacgccagccgccgcgtcctcgacaccaatacagtcagctggattaaggcctaaaatctcagcaccgcgccgaaaaatctcgggatcaggtttaccgtgtttgagactagcggggtcgacggccttcgtaaagtagtcactaagaccgagtttacgtagcacaagcggagcattttttgatgctgaagcgagggacaatgcgtagccagccgttgttaattcagtcaaaaaggcggtgatacccggtagaatgttggctggggtcatttggttaacgagctgcaaataattggtgttcttttccgtagctagcgcttgcttttgggccggtgtgacctcattttctcggtgcccttgagctagaatgaggttgagtgaatccatccgactgatgcctttgagtgcgtcagctaattggtcattccaactggccccgactttatcggcaatctggtgccaagcttggctgtgaaaagtagaggtgtccgtgataacgccatcgagatcaaagacaaagcccttgattgctgcaaatttaaccatgttggttgcctcctagattaatcggtataagtgacggaaagtggtttcttagcttgtaattggtattgctgttttccaatcataatcgtgctgggttggtccgcagtgacggttacccgttgatgatcgataacgaagacgtagtgaacgccccgaaagagatgcttgaatttcaatgtttgccagtgttcaggtagccgtgggttcacctgtaagtgggcacctagtggattgaccccgccaaagtttcgtgtcgtcaggtttaaggtcgcacacatgacgccgaggtgaatcccttcagcggtcgtcccaccttgaatgtcgtaatagtcggatgcgagggcctctgagaaaagcttccaggcatcatcgtcgttatcgtcaagctgattcaaaacggcgtaaacgatccgcgagagggtggaaccatgcgttgtgcgcgccaaatagtattgaatgttatgggtcagatactctttaggaagttgataccccatcttttcaataatcttctgaacagttgtgacatcgaagttataaaaggccatcaaggcgtctgcttgtttggccacttggtaagcatcgggtgtcttagactctgctttcaagatccggtccatccgggcgatgtcaccgtacttttgccggtaagcttgaaagtcaagcgtcggtaggttgaagtacccctcaaattgagcaatgattccccgacggttgatttcaagtgttaattgatgactgatcgtcgttaacgcttgctcagccgttgagtcaaattgtgcggcctgagctgccgcttgaaaagcagcttggggcatctgcgcccgaagcgtggtaatcgtgtcaaagagccacgcaaccatgatattggtataggcgttattcttcaatccagcggtcgtgctgtttggatagttttcatggaattcatctggtcccatgaccccactaatgttataacggccattagcttggtcataatctgctttactgatccaaaaggctgcgatcgatagcaacatttccataccataatgagttaagaaatcacggtcctgagtaacgtggtagtaaaaccagacgttgtaggcaatatctaacgagacgtgtcgctggagccggctattatctggatcccaggttttagtaatgggatttaagtgagtgaattgagattgttcatcacccttggatgctgattgccaggggtacatggctcccgcatagccttctgcttcggcatttttacgcgccattggtagtcgccggtaacgataagctaagagttgtttggctagttccggtcggtgcaacgtgtagaatggtaaaatgaacatttcgtcccaaaagacgtgtccccggtaagcttctccgtggagcccccgagcaccaacggaagcgtctaattggccgctttcaattgcggcagcggaaacgaaactgtggtaaatattgacgcgcagtaagcgttggcttgtaatatcgccacggatcttaatatctgtggcgcgccaagtcgcttcccaatagtccttgctagtggttaccgtattgtcaaaactggactggtcgagctcggcttggacgtgggtcaactggggatcactatggtcattactagttgcaatgacgacgttcttatcgaaggtatacgttttaccagcttctaccgccagtgaaacggtttgctgaacgccctgaggttgttgcgtgctattaaagttctcaatggcaggaacgtctgggctagttagtttggccccaattgtgtaattgatatgtgatgatttggtctgaccagaaaggtagacggtattagcagccgtttcgatacccatagtcttcagatgatgctgatcgaagacgttatagcggctaacgttgctattcacgacgctaccgtcgatttcggtatagatttgtagactacccgcaaagttgagtggggtgacttggtaacgaatgctgtaacggtgccaatcacgcatgttggcgactttctgcgaccggattctgagttgatgtccggaagcgagctgaatcaatttagtggtcgtcaagagtcccgttttcaaatcaaggctccgataagcgtcttgtaaatcatgttcgttgagtgtaaagggagtctgatgatcaataccgaaagtcatgaactgagcgttcggtaaattgactaaatcttcattcttaacttggtggtcatgaacagtcgtggtggtttgatcatagaccccggcaacgtatgtcccaggataattgtccttgtcggcgtgactttccaaaaaggcgccccgtagaccaaaataaccgttaccaatggtcaacatggcttcttgaccattattacggacaccgtggtattggccgtagtaatccaaatgccattttaaataggcacttttagctttaactgcggctgctagtccaagttgatcaacggcagcttggctaacgactgggatattaagcaaattagtcaaagctagcccgacatcaatgcgatcatagttgacaccgacgattgtgtctgagaatggataggacagtccgttttcaagaatagcagcatcgaattgaagtccggctaagcgaaccttgatgttctctagattttcaccaattgtttggtcagaattataggcaatcaggtaatgggccgttgcggcttgccctgatactggatgataagcgatatccatcgcgtcattttcaattcgcaatctaataagtttcataagtccacactccttagttcggtcattaaaaattgcaataagtaattctaaatataaaaatattaaccataactacagcctagtctctttttacaagactcgcaaatattggtgatgaaagtaggggctgacgaggttgaaagtggcgttgttttcgaaggtgaatgaacaaagtgttctggcttgtgctgatgatacttggtctttgatgcacgtccggaatagtcggacgtgcttgcattaataactggtttgaaagtgatatcacgcttcgagccatgctagttgttgggtgaccaaagcacgaagcgccataactagaatttgcgtagaatctagtcgtggcgcttcggttgtgtctttctgagaaggcctaatttgtaacggctaatctaagtgagcggggccgtcagtgggctgatcaacgagttcgagatggtcgatcgtcatcatctggcgaatcttgattgaacttgtctgaaacctgagaatgacggggtctttgtaatttagttgctgctgaaagtccgttagttcagcccgccaatcttgttcaaaaacgttggtaccgactaatgagagttttccccgaagcataattgacgcatagtctgacagttggtaatagaataaactcgcttgacgccagttttgaatgttctgcgttgttgaagtttgacgactagtatagaagtaaagttcttctaggctccgtttgataggtaagggactgagcgctaccatggtcggaaagccgtccgcatcaacagttgctaacgtgaagacgggggcggtttggatcatatgtagggctgcctgacgagtcgtgtgttgcatacttagtcacccctttacacctcagtatgcaggaatcatgggggaaagtcatacgttatgcacaccgttttcagcgattaaaaactagggatgtgatatacttaagccacttaacgcgtggaacgttatgattgattggcgctcccaaggttaacgatgttgttactgcagtcagttctgagaggacttatctaataatgaagaatggtacagtaaaatggttcaatgcggataaagggtttggttttattacgggtgaagacggtaccgatgtctttgttcatttttcagcgattcaaactgatggctttaaaaccttagatgaaggtcaaaaagtaacttatgatgaagaacagggcgatcgtggcccccaagcaacgaacgttcaaccacaatagtaactgttgggccgaaccattatcattaactggttcggtttttatttgaagtgacgggttgtcagctaaacaagaaagctaagtggtcggaatggattttgtagatgtttacggcattaagcatgagaattgtacgttagttgcacctgcgcgtgaatatcagcgggtcgttatttttatggacgcattgggccggcgctttgttgcaatgggaccggatccacaaccaactaaatatggaagtagtagccaacattggcatcaagcacagccgagtgcagctcctgaaggttatttccatattgatcaagaataaccctagcaattgagttacttagctacgctgatggtaaacattagatcgttagaaaaagccccagggacgtcacacgcactttgcgttgtacttcctgaggcttttttgtaggaataaaaaaatcagctttcacggtggattatcacggcgtgaaaactgattagtgtggttatatgatgggcagtcaggggatcgaaccctggacccacggattaagagtccgttgctctgccagctgagctaactgcccataactcaacaaaaaatataatatcatgaattttgagttctgacaacactatttcgaaagttttttcgaaaaaagtgtttttttgagtaattaattggtgaaaacgattgcttgaactggcaaatgatttcccgggaaatactacggccacgcggattagcaatcaaagaaagccaactacatttgtgatatactaaaaccagtgttgaatttagtttcaaccaacctgacacgagaaaggacctgttttctcgtaatatatcgcgaatcaccctaaaaattgaaatgtaaacctgttttcccctaaggaggaagaatcgttatgaaaaaaatcttagtagttgatgatgaaaagcccatctctgatatcatgaaatttaatctgaccaaagaaggctatgaagttcacgttgcagctgacggagaggaagccttacaaaaagtggatgaagtccaccctgatttgattttgttagatttgatgttgcctaagatggatggcttggaagttgctcgacaagtacggaagaactatgatatgccaattatcatggtaacggcaaaggactctgaattagacaaggtgttgggcttggaactgggcgcggacgactatgtgaccaaaccgttctcaaaccgggaactcgtggctcgagtcaaagcaaatctgcggcggcaaggtgcaccaagtgcccaaccagctgaagttgaagaaaattcagacattgaaattggcgatctggtgatccatccagaagcttatatggtttccaaacgcggtgaaaacatcgaattaacgcaccgtgaatttgaactgttacattacttagcccaacatatcggccaagtcatgacgcgggaacacttgttgcagacggtctggggctatgattactttggtgatgtccggacagttgatgtgaccgtgcggcggttacgtgaaaaagttgaagataacccgagtcatccaaaatggctggtgacgcggcggggcgtgggttactatctccgcaatcctgaaaatgagtagaggttgctaaaccgtgttgagatttaaacggaaaaatttttttaaaacaattaatttcaaaattgcgctcgtgtttgcccttctattattgattacgttggaaatcgtgggtgcaatctttgtgaaacagttggaatcaaagaacatccaggattttaaacagtcggtgcaaattccaacttatattgataattcgttgtccgaacaattgaccgtcagcagtacgcgcaaggccaacggccaaatcaagacgattttgtcgaactacaacaatacgaatgttgatgaaatccaagttgttgacagcaaaggaacaattcgtgggacgagtgatgttaatgatcagtcagtagttggacaaaaaacgaccgatcgaaacgtcaagaatgcgatctataataatcgaacttacactaaaagtacctatgacactcagaataatggacgctactacgtttcaatcgtgccgctatatagctctaattcagcgggtaatagcagtcagttagttggggtactgtatgtacgggcaaatatgaagtctgtctacagtacgattaacaacattatgggaatctttgtgattgcgtcacttgctgcgatggtcttgggactgggaattgcaatcattattgcccgggcaataactcgtccaatcgaagaaatgaagcagcagacgcaacgaattgcccgtggtgattatgcggggcaagtccgagtttatagcgatgatgagttgggccagttggctaaagccattaataacttgtcgattcgagtggaagaatcgcaagagtcgacagaagctgagcgacgccggttggatagtgtgctctcacacatgagtgatggcgtgattgccactgatcgccgggggaatattaccatcatcaatgaaacagcctcggactttatggatgttacggccgaaaaggcaatcggtaactcgattttagatattttgaaaatccgtgatgattattcattgcgtgatttgattgaaaatcaagatgaattgatgcttgatttttcttcgaacgagcgtgacctaatcttgaatgcctacttttcgttaattcaacgggagtctgggtttattagtgggttagtctgtgtgctccacgatgtcacggaacaacaaaagattgataatgaccggaaacaatttgtttcgaacgtgtctcatgaattacggacaccactgactagtttgcggagttatattgaagcactgagtgatggtgcgtggaaggatcctgaagtggccccaggatttttgaaggtcactcaagaagaaaccgatcgtatgattcgaatgatcaatgaactcttaagtctatcacggatggactcagggaccactcgggtcgatatggaattggtcaatattaacgagatgttcaattacgtgcttgatcggtttgatatgatcttaaagaaggatgataatccagctaagtattacactattaagcgcgagtttaccaagcgtgatctgtgggttgaaattgataccgataaattcactcaagtattggataacattatgaataatgcgatcaagtattcacctgatggcggtgtcgtgacttgtcgtctgttagagacgcataaccaagtgatcattagtattagtgatcagggcttgggtatcccacgggccgacttaggacacgtctttgaccgattcttccgagtcgacaaggcgcggtcacgggcccaaggtgggacgggcctcggtttggcgatttcaaaagaagttgttcagatgctcggcggtcgtatttgggttgatagtgttgaaggtaaggggtccacgttctatatctccttgccgtacgaaccttatgaggaggaggacctttgggatgacgactcacaagcttagacgctttattttacccattttattgacgattctgatcttattgagcgtggttttatccatgtatatctggttgaatccgtcacgctatgagcatgaaagcaaggttagtacgacgtcatcgaactcttcgttgacaactcggacaatcgatgatatttatttaccgacacaattaattcacactaacagtcagggtggccaatccctgctgattaataaaaatgtcagcttagtcagtcaatttagtgagcagttacgcaaatgggatgcgcggagtatctctaaagttcgcattacatcagcaaaaagctaccgtgcgctcttaaatggaactgattcgtacgtattgaactttcctgacagtattactgtcagtatgtttaatacggtcttcaagcaacatctcagtaattttcgctcctcggaatttagtcggatcgtgattccagtcaatgatacgaatcacatctactttttgaatgatgaccatcatgagatttatagtgttcggttgaagaaaaaatctctgtcgtcgttgaaaaaagttttggcagtcgacaaggtcaaacggattgctgtcaagatgacctatgaggataatacaacgtatattgattatccaaagcaagttacgatgcaacattatagctacttgatgagtaaagcggccgcgagtgagattgccaaccgattactagatgcggatggtaattcgaccgtttcagtgcataatcgcagtggtaaacaggagtatacaacgggtagttacaagcgcatgacggtggattctaagctaggaacagtgtatttcgaagattatagtgattcaggaaccacgcggaacctatcactgactaatcagctaaagaagagcttcaatttgttaactagtctcggtgtcccaatggataatatccgctactacggttttgacgcaacgagtaatagtgtcatttaccggagctatgttgaagggttcccgatctttaatcagaccgaaaatggcgatgtccggattcagctcacttctaacgggttagaccgttactacttctcactgtacagtttgcaggtgccagtaccaactactggtcagaagcaagcggtgaccttaccgagttcgacaagtgtgttaaaacgtctgaaggccgctggttataaagacagtaaaattggcagtattgaacttggctacgaatggtcacagaacaagtcgtccaaactcgtgatcgacctgacgccgacgtattatgtctactataatggcacttggcggacatatacgtcgatgttaagtggatcttaggaggtggccgcatgaattttcggagaattgagtggattttcctactagcatttgttgttctagatatcttcttgggttttatgttcgtgcaaacgagctctaagtcgacacaaacgactggtgatacggcgactacgataattcgtgaaatgcgcgcagataatattagctttaaaaacccggacacgagcgaagggacgggttactatattgcgggcagtaacgagagtggtctcaaacaattgttgagtcagttaactgaacagacagcccgggtgcaaagcggcggtaagctcgtgagcacactacgggcaaccatcactatcgatacccgcaatcctaaagcggacttgacgacgtttatgagtcagcggaccaatgtaatccatggaaccgagtacgtctatgatgcggatttgtcgtctaacggcgattacgtttttgttcaaaaggttgcggatggcgagatcatgactggcgctgggcaagtccacctatttgttaataaaaacaagcagctgacaagttatactcagacgtacgtcaatcacgtcaaaactttacgcgaaaaggctgttacaatcagtgaaaaaaaggccctggttgcgttgtatcaatataatcaggtggcaagtagttcccggatcgtttgggcaaagcttgggtattctcggttattgaaattgaaggatagtagtgtttacgtcccaacgtggatctttgcggtccggggtaagaatagttctaacgttacactgcaccgtatcaatgcctttactggttcttcaatgaagaacggtagtacggctagtgatacgagtagtttagatgcgacggtcggaatgatgtggaatgcaattgattagtgaaaaccagtttaacgactaggtgtcgttgtcgaataacgggtgctgtgaagaagagtgtttttcctaacaggcccgttttttggtgactaaatttttgactagttgtgatacgccaatgtcgaggtggcatgacgtagcgtggattgctcagcgttgatgttcgcggtttcgtgtgagtttaatggccggtaaactagtgtgcgcatacacgacagtaaactagactaaccgcgtgatggcgatagtcgtggacgttaagtttgagcacttgcaggtggcttgcttttcaaccccgctaaaagcgtgtatcatatgaagatagtaatggatttcagagataggaagagcctaaataatggtattaaaattagcaacggatgatatgaaagtaagcattctggcatcgggtagtacgggtaacgtgacgtacatcgaaacgccagagcacaaagtattggttgatgcggggctaagtggcaaaaaaattgctaatttaatggcgtcgatcgatcgtgatattaatgaagtcgatagtttatttattagccatgaacacactgatcactgccattctgcggggattttagcgcggaagtatggtatggatgtttatgctaatcaggggacctgggacgcgatggcgcataaaatcggcaacgttcctgccgaattatgtcatgtgtttgacccgaacacgacgcttggactaggtgatctcgacgtggaatcatttagcgtgtcacatgatgcggccgaaccacaattttacgaactccatcatgccggaaaatcgtttgtcatcattacggatacgggctacgtttcagagcacgttgaaggtgtaatcaaagacgctgacggctatttatttgaatgtaatcatgacttagaaatgttgcggatgggtcggtatccatggccattaaagcagcgaatcattggcgatgagggtcatttatcgaatgaagatggtgcgaacgccttgatggatgtgattggccggcataccaagcggatttacttagggcatcgtagtcaggataataacttgaagtccttggcgcatttaacggttgcttccatgatgacggaacgcgattttggcgttgagcatgattttcaactgtacgatacggagccagaacaagcgactaagttaatcacgttataggttagctttaatgtttcacaacgcttcagtcataaaaaaatcacactttttcgctaaaataaacttaaaataagcattagtagggagggatcgcgtttcgacgcgcaattatggctaataaatcattaatcaaagtcgcagtaaccgcactagtagctggtttaatcggtggtggtgttgcttacggcggtattaattatttccaaaacaataacatcgcaacgtcatcgaccagtgtgccaactggttctaataaatcggggtcgacgtcaacgacgaacgttaaggtcaatgtcagttcacaggcgaccaaggtgtttgaaaacaacaaggcggccgttgtatcggtcattaatctccaaaagaagagctcttcaagtggttggagtggcattctgggtggcgatgactcgtctggcagtgatagttcatccagttcagattccagctccagcaagttggaagagtacagtgaaggttctgggttgatctataaaaagagcggtgacgcggcttatattgtgacgaataatcacgtggtgagtggttcaagtgccattcgagtgattatgagtgatgggactaagttatcagctaaaattgtcggaaccgattccgtgaccgacttggctgttctgaagattaactcgtctaaggtaacgaagacggctagctttggtaattcagatagcatcaaggtcggtgaaacggccttagccattgggtcaccgatgggctctaattacgcgacgaccttgacgcaagggattatttcagcgaagaaacggaccgtggcgacaaccaatacgtctggtcaaacgacggggtatgcgacggttatccaaacagatacggcaattaactccgggaactctggcggtccgttattcaacattgctggacaagttattgggatcaattcgatgaagttggcttcagataattctgggactagtgtcgaagggatgggctttgcaattccaagtaatgaagttgtgaagatcatcaatgaattggttcaaaagggtgaagtcgttcgaccagccttaggggttgcaacctatgacctatccaatatttcttctagtgatcagaagtctgttcttaagttaccaaccagtgtgacgaagggtgtcgtcatcatgaagacgtactcaggttcaccggctaaagctgctgggttaacgaagtacgatgtgattacggagctaggtggcaagaaagtgaccagcttagccacgttacggagtgccctgtatgcccattcggttaatgataccgtgacggtgaaatactaccataacggaaaactcaagacagccaacatgaagttgacggaaactaccaaaacgttaactaaacaaagtaactaataaatgagaatttcataaacgtccctgactggataaagcagtcgggggcgtttttttaggttagtagccgaaatcctgaaaaaacgaagaatcgattttcaataatcgactaaatttgcgaaagctggcaatggttgcgacaaaagccgaacaaactggttgaaatagcagaaagcatttattgtcgaatttgatggtgtgcaaaagtgtggacaactttggtgataaattttagccgcgttagtcgaaatttatgaacagccggaaccacggggttgaagcttgtttaaaagttatccacaggtgctggactggcctgtggatttaattttaaaaagttattttaataggcctcggttcttgatataataggatttgtaaccggaatccacgaacaagtgttgctgtgcaaaactgtggataagtcggaagggtcttgacaaaacgaggctaaataaatattgtggcgaactggtgttcaatacaatatattgattattgagttatgcacctgtggataactatgttaataacttgtgtaaaggcggtcaattatgaacatcaaaattatctgtgtcggaaaattaaaggagaaatacttcaaacaggggattgcggaatatgcgaaaagaatgagtaaatttgcaaaattccagattgttgaagtgccagatgaaaaggctccagagtcattaagtaacgcagagatggaaaatgtgaaggccaaagagggccaacggattctagaaaagatcaaggatcgcgattacgtatacgcgctagcaattttgggcaaagaacgctcgagtgaagaatttgcggcggaaattgataagttaacgacgtatggtcacagcgatattgattttgtgattggcggttcgctggggttatcaccggaagtgctgaagcgcgcggatactcagatttcgtttgggcgtttcacgttacctcaccaattaatgcggttagtgctgtcggagcaggtttatcgggcgtttatgattaatgtgggaagtccgtatcataagtgatgtaagattggctcatgaagataatgattttaaggtggaaaatcaatatgagagatgaagagtactttaacccggaaacttttttgcttattcgtgatcaagtcctgaatctttgggatgagatttctcatgacttgaaggagttcaaaatacagtcggaaaaaaattcgttttttccagtgggggaagtggatttgattcgaaaaatacaatttaaaatcgtcacagcattacattatagtgggatgatacttaacttatatgagcggttgaaatcattacaaaaatcgaatgaagagcttggtgtgttcattttaaatcattccaaggctgacgatataatcattaaaatgttgtttgctattgatcgagtaaataatattcaaaagcatttgcttatggccaacattaaagaagaaaatgatgcttttgtaggaattgttaaagacgataaaaagttttattgggtgcgagataatgttagcaatgtttcttctataaaggggaaaacaaaaaaacagattgatgattataaatcaatgctttcacaacaagaaattgccgtaaccataccacaaataaaaagtgctttatttggagtgggaataccacgaatacctataaattaacttttatattttatagattaggaggagacgaatggctaagaaaagtagagaaagtaaaaaactcattaaaatcatgtattttgatgagcaggctgcggtcgatgcacttgagattattgatggtggtagtgcgctagatgttattaataaatcattggagaagggaaatttttctggagtaagtgcgggggccggtaagtcgtttatggggtttttacaatttggtttaaaaggaaatgctaagcgcgaaaagaatacaatagttcaaagtaaagttactagtacgttaattagtaagtttattgatggagtaactaatggtagcataaatctaattgaaacaaacgctccggagcttaatattcaaaaggaatcaaacgcgtactatagagatcttttacctatgacacttgttgtaaaagatattagtgccatagatgttgatgctgatactaaggcagttttcaagggattagactttgacaaaatgggaacaatgttagattcactgtcagcgtactatgagcttgaaggtgtttatgagaaaaaaagggcgatatacaggtttaatattgatgggttaagaaataattatacattgcttgatttagaaaaggtcaccaatatgagagtgtatggtttgattgttggtaaaagtaagacgatggatctttcttttaataagaatatggatagtttgataaatgaatctacgcaagtaccagttgattttcaggaaatgattgataaaaaggtgaatgcaagtggtgaggcaaatgaatatccaattattgatgttattttggcggggatagaatcatgaaaattgatgtatatttcgaaattgaaaataaatttagaaaaagggtttctcaaggcgataaaagctttcatttgaatgaattcttaagagacgtaggattactaacggcatctactataagtgacagtacaagtgtacttgatgtagagaagtataagggaatggacatgtgtatcattgatatgtcggatacagttggattaaaatcgtttgtttttgagcagatggaaagtttcataaaaatacttgacgcatatggcattggaaaaatagtagttaataatcctagcaagctgttattgtcgtcaatatccaagcttgataacgttaccctacataaggaaagttcatttcgaaggataactgataagcaaatacagagagttcagaataggctttctaagaatattataggtcaaaaaagagcaaaaacagtgatatttagaaaactcgttgtacaaagaattaggaatagatcgaaacctctagtattaatgttttatggaaaaccaggaataggaaaaacagaagttgcaaagcaaatatccaaggctatatatggttcatcagaagttttaagggaacagatgtcgatggtaggtggagctaatagtctggaatactttaaggcaacaggacatagtgaagatgcattctcaaaaaaattattgaatagaaaaacaaatcttattcttttggatgaatttggattagcttactggccttttgctttgcactcgcatccctttttgcagtgaccatgaccattatacagaatcgtaagcgtgaacgtgtcgttgaacagtggccaacctttaatcccattaatcagaaaaaacggcagcaactgctcgctcagttcatggcggaccgtttcggcaatgccgaatttcgtgaacatacccgctactaccgggtcaagccagaacaaaatctcgatactaatcagattcaacaactttatcaacaaaataatttagacgatattaacgattaaccaggggacgccatgacaaatatttttattgaccacatattcgccgcaaccttatttaaatcggtaatcaacatcgcactcctgattttatgcctctaccccatcgttggctcttttttctggttcgccggcgcgctatcctaccgatttatcaagaccaataagcgtgatgatgactggcagtacattccggctgaacagcaaccaatgattaccatcatgatcccggcgcacaacgaagaagtcatgattgaagaaaccatcacatacttatttacccagctcaattatacgaactacgaggtcctagtcatgaacgatggttcgaccgacaagacggccgccattattcaacggttgcagtccgtctatccacggctacgaaccgttgaaatcgagaaaaataagggcaaagcccacgccttcaatatcggcatgtactttgctcagggtgagtatattctcagcaacgatgccgatacgattccagaaaaggacgccctgatgaagtatatgaacttcttcatccatgaccgcgatatgaatacatccgccgtcaccgccaatatggatgttcaaaatcgaacgtcgcttttaggtaaatctcaaaccgttgaattctctagtatcgtcggtgttatcaagcggagtcaaacttccatcaacgactctatgtacgcgtatagcggggcaaataccctctaccgcaaacaatttctaattgacgttggtggctttcgacaaaatcgcgcgacggaagatatcagtattgcctgggatcaccaaatggtgggcgccgtcccgcggtttgcccctaacatcgtcttccatatgaacgtccccaccacaatccgagacctttatcatcaacgcaagcgttgggcacagggtggcacggaagtgtggttaacgaacattaagaaattcattttccacccaatcgttcatcgctatcaactatcaatgttcgtcgattcgacgttgtcaatcatctggtcctttttcttcgtcatcacttccttgatgtttttgattctgatgggttacttcctgataaccggcaattttgaacgagtctaccacggcttgatgttgtcatttgtctttgttagttttgaactattggccgggttcatgcaactgttagcggcactcctgttggaccatcatggtgcgaaactaaagtactggttcttcgccccactctacatgttattttactggatgatcaatcctatcaccgtcgttgcaacgtttattcctgcactcaaaaccattctgggctttggctccggaacgtgggtcagcccgaagcgacagtcattgcagggtaaaaagtaaaacggtgtcgctattaacgctttcaataatcgataacgggtctactggtgcgagaacttgcaaccagcccaactaaaaacgtgcacttacctgagtgataactgactcaggtaagtgcacgttttaatattaatcccttttgatcgttttcttagctatgcaaatggagctgcccagactacgctgagtaacaggtcccatgtgtcacgtgccactgaacacagagatcggcaggtaaatcacgaacggcctcacgacttacctgtgtgccaagttcagtaattgatcgcccttgctgactgccgaggccctggcgattcagctgaatcgtccgcgcaccaactcgatacaagtcactcatgatctggtggtaggctgcggccaagtcatgcaccatttccgtatctgattgatagactcgattaagtgcgcgcgcattatcggaccgtttgagttctgccaagcacagctcgggagcgggcaagatttgtttatccgcagttccaccactgatttgattgcgcatgaattcaaaatgcgcaacggcaggatggttgaagccactgattttaccggtcaacgcgagcgccggcaccaaacctatcccggattgggtgatgccttgtagcccccagaaaaagttaaagtgccaccaatttagattatgcggcttatcaaccggtttccgaatatgatgcataaaagcagcgtcctccatccgtttaagtcccgccgcattaatattcagcgttgttgtgccccgatgcaaccctttttgagaccgcattgccatttgccaaccatgtacacggtgcctaaccatcatcatcaatgtgccaaattccatgcccgtttagcctccaaattaattgcattctgccaatataaaaatcgtcccctactgcttaaaaaggacgatttcaacgtttgggtcagcctttaactgccaacaccaaccattattcttttatgacgaatttaagtaatgtttccagcatagaatggtgctcaccgaatgtcaagcgctaatcgtgggacgctgtcatccccttaacgccaatatcagttcggtacactagatcaccgactctgagttggtcgatttgttgataaacagcccgctgtgctgcgaccaagctcggggcacttgcggtaaccatcatcacccggccacccgcactgactaattgatccggggtacccgcaacgctagcataatccgcaccagcaaccgtcggaaccggtacaccggcttcagttggtcccggataaccgggagcagctagtacgacgccaagataagttgccgtcgtttgccactgcgcgtgtggttgccgatgttgcagtaagtcgacgatgacttgataaaaatcactctgtagttgtggtaataagatctgcgtttcaggatcacccagtcgcaaattatattcaataacttggacaccactcgcagttaggatgcccccaacatagatgaccccttcaaagctcaacccatcggctttgagacccgcaatcgtcggttcaataatcgtcgcaatcgtttgatcaataattgcgggcgtgatttgcggcactggtgaataagcgcccatgccacccgtgttcggtccccggtcatggtcctgtaaccgtttatgatcttgggcggtcggtaataacgcatagtgctcaccaccaaccaaaaccatttgggaaaactcaaagccagcaacgtagtcctcgatcaagaccgtcgaactagttttaaaggccgtcttaatcgctgccgcggcttgttcataactcgtcgcaaccgtcacccctttaccagctgccagcccatcgactttgataacttgcggcaccgcttgttcatgactataagctagtgccgaatccaattcatgaaattgccggtagtcggccgtcggaatgtgatggcgactcatgaaggccttcgcaaataccttagaactttccaactgtgccgcagcttggttggggccaaagatagccaggccggctgcttgaaagtaatcaacaatgcccgcggctagcggtacttcgggtccgacgaaggtcagggtaaccgtattggcccgtgcaaagttgaccaaccccgcaaagtccatttcgtcaatcgctagtgtccgaataccatcccggatcatgcctggattaccgggtgcacaatagacggtactgacttgcggacttgccatcattgccttggcaatggcatgttcgcgaccaccaccaccaactactaatacgtttgccatgcacgcacccatcctttcattaatgccggaagtgtcgaacaccagtggtgaccatcgcaataccataacggtcggccatggcaatcgaatccttatcgcgaatactaccacctggttgcacgattgcacgaatgccgtgctgtgcagcgtattcgacacaatcatccattgggaagaacgcatcggaggctaagatagcattttcgtagccagcttgttgcatcgccttaccgatggcaatcttagttgaatcgattcggttcatctgaccagaaccgatccccaatgtccgatctgcggtggtcacaacgaccgcattgctcttaacgtgcttcacaacctgttggccgaacgcaagtgcttttagctgtgcttgtgttggctgggtagcggtgactacggtaaaatcagctggcgtttcgaaggccgcgtcgacctcctgacgtagtaagcccccaccgactgaaatcgtttcaaacttatcggccgtgtgcgtttgctcaaagtcaaccgtcattaggcgcaagttcttcttcttggctaaaatagcaaaggcatcgtcatcaaagctcggggcaataataatttccaagaagagtgcgtgcattttttcagccgttgcgagatcgactggtcgatttaaggcaatgatacccccaaagatcgagattgaatcagcttcataggctttatcccaggcagcttcgatggtcgtacctaagccgaccccacacggattcatatgcttcatcgcgactacggccggctgttgatattcactgaccatccgcaaggcggcatccgcatccttgatgttattgtaagaaagggctttcccatgaatttgcttggcacccgtaatcgagaagtgcgtcggtaaagcattttcgtaaaaggcagccttttgatggctgttctcaccataacgcagggcctgcttcttatcataagtaagggtcaacttttctggaaattcttcagtcgttaaatattgggcaatcaaggcatcataggccgcagtatgttgaaaaactttggccgctaatcgttgacggagtgccggtgtgaccgcgtccgtctgcaaatcagccagaatctgctcataatcagcaggatcaacaattggcagtaccgcggcaaagttcttagctgcggaacgcagcatcgacggaccaccaatatcgatttgttcaatagcttcagcttgtgtgacgtctgattgttgaatggtcgctttgaatgggtacaggttaaccacgaccatgtcgatcggctgaatcccagcttcttttagttgcgccatgtgcgctggcaggtcacgtcgtgctaatagtccggcgtgaaccttaggatggagcgttttgacccgaccgtcaagcatttcaggaaaaccggtcacttcttcgattccgatgactggaatatcagctgcttccagtgcctttttggtcccacccgttgaaatcaattcatagtcaagggcaacgaggcccttcgcaaaatcagttaatccctgcttatcagaaacacttaacaacgcacgttttgtcatcttaaattgctccttcattaatgagtgtctgtaatacatctggataaaattggtgttcacaatcatgaatccgggtcgccaggctggctagcgtatcgtctggtgcaaccggaacgacccgctgggcaataatttgcccggtatcgattccggcatcgatatagtgaatagtgacgcccgtctcggtcacaccagcggcaaaagcatcctcgataccgtgacgacctggaaatttcggtaacaatgctgggtggatgttgataattttatgcgaatacgcattcaagagggtcggaccgataatacgcatgtacccggccaataagaccagtttaatttgtcgcgcttgcaaggccgtcaaaatgatagtttccgcggccgctttattcgcataatcatgaaaatcaacaatcaatatcggtacgttagctgcccgggctttatcaatgaccggcgccgtgggttgatcacagacgagtaacccaatcaccaccggtaactgccgttcaataatcgcttggtacagcgcgtcaaagttcgtgccgttccccgaagcaaataccgcaatcttattaggcatgttcagcctcctcgaaaatgacgggggccgtcccagtttggactgttccgacgcgataataggactgcgcgttggccgttaaattagccgtcacagctgccacttggtcggggtgaacgaccagaaccattcccaggcctaagttaaaggtcgattgaagatccgtggcagtcagcccaccgagttcggctaataacgtcataattggtggtactggccattgacccaattcaaggtgtgcactcaagccgtccggtaacgctctggcgacgttttcaatcaagccgcccccggtaatgtgggcgatactcgtcactaatttttgctgtagcaatggttgaactgcatcaacgtaaatagtcgttggtcgtaacagttccgtttgtaaatcatgaccaagttcgtcaaaaaccgtggtcaattggtagtcgtgttgtttgaataaaatatcgcgaactagactaaacccgttcgagtggaggccattcgacggtaatccaatcaagacatccccagcccgaacatttgctggtgataacaggtccgcgcggttcgcaattccgaccgcaaaaccagcgaggtcgtaatggtcctgaccatacatatcgggcatctccgcagtctcgccaccaatcaacgctgtatgggcctgctgacagcccgcaacaacgccagtcaaaatggctttgacccgcttctggtccgtatgtccgaggcctaagtaatctaggaagaactggggcgtcgcgccttgtgccaaaatatcattcacacacattgcgaccaagtcaatgccaatcgtggtatgttgatccgccgcaattgcgactaagagtttagttcccacgccatccgtccccgctactaacacgggatcgttggcagttgcatctgaactaagtggaaacgcccccccaaacgcgcctaattgctgattaccactcatttgtttgaccgtctttaagacgtcgtaaccagcgttgatatcaacgccagcccgcttatacgcatcactcacttgatcaccccttcatgattggcttgtaattgcgcgatttccgcatcatactcggcttgataatcatacaaggccgttggataatctccattaaagtaagccatacatagcccaccatatggttcggtggtcgacaagccaactgcatcgacgacaccctgttcactgagaaaacctagcgagtcggcaccaaacgtctgacacatctcaggaatcgtttgttgagccgcaatcaactcattagtcgattgaatgtcgataccgtaaaagcatgggtagcgtaatggtggcgatgcaattcgtaaatgaactgacttggcacccgcatctttcaataatttgacgatccgccgactggtggtaccacgtacaatcgaatcatcgattaagacgacccgtttaccagcgacgacccctttgactgctgaaagtttcatccggaccccttgttctcgcaatgcctgggttggctgaataaaggtccgtgacgagtattgattcttaattaagcccatctcataaggcaggccactcgcttccgcatagccggtcgccgctgataaggatgaattgggtaccccaacaacaatgtcggcgtccacgggctgctcaactgcgagccgagcgcccatgcgtttacgtgcagaatgaacgttgacaccgtgaatatcggaatctggccgtgcaaagtagataaactccattgaacaaatcgccaactgtgtatcagtcgtataatggtcgatcgtcaagccatgatcatcgatcgttaacaattctcccggctgaacatcctgaacaaacgtcgcaccaatcgtatcaagcgcgcaagtttcactacaaacgacgtacccgcccgtgggtaactgaccgacgactaatggtcgcagcccgtttggatccaacgcagcaattaaacaatcattcgttagtagtaagtaagcgaagcccccgtggacctgacgtaaagcatccttaacctgttccgttaacgttgctgcggggctgcgtctaatcagatgcattaaaatctcactatcagaactggcgtgaaaaatcgcgccgtgctgttccaaccgtcgccgcagtgtcaccgcgttcgtcaaattgccgttatgtgcgagtgcaaactgtgagtcgctaaaattaaaactcaggggttgaatgttttccaatccatgattgccagccgtggcataccgcacgtggccgactgcggcttgacccgtcaaacgagccaaccgccgtggatcccgaaagacatcagccaacaaccctagtccgcgttccgtctgcagtttgccgtgatcattcgccgtgataccggctccttcttgccctcggtgttgtaacgcatggagcccaaagtacgttaattgggcggcgtccggcgagccccaaaccccaaagacgccacattcttcattcagacttcttacttcagtaggcatggtaaggccccttcccacaactgtttggcgaaactaaccttaatatcaaacgcctgatcagcagtttgaacgtgtagccgatccgttgcagttgttcgtcctaaataggtcacatatggttccattaaactttcaaacgcggcttgctgtgctggtgtcaccgagataacaaatcgtgactgcgtttctgaaaagaagttggcagcgggcaagtcactggccagttccaccccgatattttgtggaaaacatgattcggcaatcgtcgtaatcaagccaccttcagaaacatcgtgggcactagcaactagtcctttttgaatcgcagttaacaatagacgctgattgcgattttccgtcacaaggtcaaaatcaaacaactcgccactgatcgttcccgttaacatcttttgcagctcactaccattgaaatcagcttcggtggtccctaatacgtagactgcatcgccagcgtgcttgaaatcactagtcgtaatatctttctgatgctttattaacccgaccatcccaatcattggggtaggatagatggcttccccgttcgattcattgttcagcgagacattaccggaaatcacgggcgtattgaataattggcaggcccgagcgatgcccatcgctgattcgtccaaatcgtaaaattgttcaggtttctctggattaccaaaattcaagcaatcagtgatacctaaaggttgcccaccggaagcaacaatgttacgggccgcttcggctacggcgatttccccaccgatacgggggtttaagtataagtagcgtccgttaacatcggtagtgatcgccaacgccttatccgtatgccgaatccgaataacccccgcatcggaccccggcttgacgaccgtattcgtttggacctgcgagtcatacgttccatataacgacgctttggaagcaatcgttggctgttggagcatcttcttcaatgtgccagttgcatcaactagtcgtggcataaattgatgatggctctgatggttcaagcgcgttggtcgtttcttttcgcgttcatagaccggcgctttggtcgcaagtgcatcgacgggaacatctgcaactaacttaccatgatggaataattgatactggtggccggctgtcactttaccaattgtgacagcatcaagaccgtacttttcaaagacttgataaatttctgcttcggcaccagctttgacacatagtaacatccgctcctgtgattcagagagcatcagttcaaacggcgtcatgccagtttcacgttgtggtaccaagtcaagattcagtgacaacccactgcctgctttggacgccatttcggctgaggaggaaactaggcccgccgcgcccatatcttgaatcccgattaaaacatcacgatgatcatgaataacctcgagacacgcctccatcaataatttttccataaagggatcaccaacttgaaccgcggaacgctgggtttcattggcgtcattaaattcagcagaggcgaaggacgcaccgttaatgccgtcacgccccgtttttgcgccgacataaataacggcgttgccaattcctgttgcttggcccttctgaatatcagcttgatccaagattccaacacacatggcgttcaccaacgggttcttctgataactcgcatcaaataccgtatcaccaccgattgtcggaattccaatacagttgccataaccgccaatgccggcgactacttgcgaaatcaagtatttcgtatgagcatcagtcggttccccaaagcgaagactgtccagcagcgcaatcggccgggcccccatcgaaaagatgtcccgaatgataccacccacacccgttgccgcaccctcataaggttcaactgcagacggatgattatgactttcagctttaaagaccacggcctgaccatcaccgatgtcgataataccggcgccttcaccaggcccttcaagtacctgttcaccctgcgtccagaattttttcaagactggttttgaattcttgtaggagcaatgttcgctccacatgccggaaaacaacccggtttcagtctcgttaggtaagcgttgaaggaccttatccgttaataattgatactcagcatcggttaagccccaatcccgatagaccttagaatcgcgaacatctgtaggtgataatggttgctttttaagcatgggtgacctcctcttgactcgcaatgaccgattgaaaaattccgagaccgtccgtggaacctaagatcatctccacggcccgttccggatggggcatcatcccaagcacatttcccgcttcatttgtaatgccagcaatattagccgtgctgccatttggattctcgacgtattcgaagatgatttgatgattagcacgtaattgcgccaaggtggcctcatcacaataataattgccttcgccgtgggcaatcggtaaactaatttgatctgtcgatccgtatgcggtggtaaaaatcgtctcatgattggcaattcgtaatgggctgtcctgacaaataaacttcgctgagcgattggcctgcaatgcaccaggtaataatccggcttcggtcaagacttgaaagccattgcagattccgatgactggtttaccagcgttagcaaatgcaataacggccggcatgatgggcgcaaagcgagcaatcgccccactccgtaaataatcaccgtacgaaaagccaccaggtaacaccaccgcgtcataacctgctaatgaggtcgctgtcgccggaatcaaatcagccgtaacgtgtaaaatatcgcgcaaggcgttcaccatgtcatgatcacaattagaaccaggaaagactggtacggcaaatttcatcattacaaagcctccatctcagtaatttcgtaacgataagtttccatattaacgttggctaataagcgatcacacatctcatcgatttcagcagccactggccgatcatccgcgtgaattttcacctcaaaatacttacctaattcaacggcatcgacattcgtatatccgagtcggtgtaaggcatcatggattgcctcacccttggggtccagaattgattgcttataagtcacatagattttaactaagtacatgttaggcctcctcgacggttgctagccgcgtcaatacttcctgataaacactagtcaagtcgcctagatccttgcggaagacatccttatcaagcgatgcaccggtctttaggtcgactaaccgacaactatctggtgagatttcatcagccagcaagactttaccggtggtcgtcaacccaaattcgattttaaaatcaacgagctgtacccccatcgccgcaaaaattgccgtcaaacgctggttaacctgtaaggcctgccgtttaatttccgccacgattgccggtgttgcaacatttagcgcgtggatttgtgaatcattgataaatggatcatccagctgatcactcttatagaaaaattccagtactggttctgcaaatttggttaagtgtggcacggcaaatttacgctcaaaactacccgaagccgcattccgaacaactgtctccaagggaatcatggtcacgcgacggacaagttgcacgtagtctgaaggttgctcaataaaatggttggcgatgccgtgattggctaagtctttgaaaatcaaacttgcaatccgattattcaagcggcctttctggtcaatgggaaccttccgcttaccatttagcgctgttgcttgatctaagtattcgacccatagaatttcaggatcattagtagcatacatcgctttcgctttacccgtgtaaagcaaagcttgtttctcaatcgctgccgtcattattattgttcccctttcaaatttgccaccgacgctaatgctgcgtcaatatcgtgatttaatacggtgacatggcccatcttgcgctggggcttaatggccgccttaccgtagtcgtgaaaatgccattctgggtgttcaaccaactgttgccgtgccactgttaagtcatcacctagcagattacgcatcactgccggactggtctgcgtaatggccggaatcggtaagccacagatacttcgaatatgggcctcaaactgcgagatgttgcaggcctcaatcgtatagtgaccagaattatgtgggcgtggtgccagttcattgactaataaagtatcatccggtaaaacaaagaattcgattcctagcacgccacgtagttccagggcttcagcaatcgaaaccgcaattttgcgggccgcactatgaacactgggctgaacattagccggggcaatcgttgtgtgtaagatatgatgttgatgctgattttcaactaacggaaaagtcgtaacaacaccagcagcactacgcgtcaccatcatggaaacttctgttcgaaatttctgccgcgcctctagaatgcacggctgtgtcaataaggcgctagcggcttttgtcaccactgctgtgtctagatccgtttgtccatgaccatcgtagccacctgccgccgttttgagaattgccggcgtaccaacacggttgagggcgtaatttaatgactgtaaatccgtcaccggtgcgaaagatgtgactgggatgccatgatcatgaagaaattgcttctcattaagacgatctccagtaatatgcaggagtgcagtgccctgcggtaactttgcataggcttgcgcagcaatcaaagcattctcatcaacgttttcgaactcgtaggtcaagacatcactacggcgcgctagatcaagtaaagccgcctgatcatcataagccgcaacaatctgaaaatctgcgacctgggctgccggtgctttgggtgtcgggtcaagtacacctacccgatagcccatcgccttcgcgctaagtgccatcatctgaccgagctgaccgccaccaacgattccgatcgttgcgggtggtaagagtgcttccttaaaattggcgttcactttgttcagcctcctgacgttgacgagcacgaaattctccaattgcacgttgcacttgtggttcccgtaaaccgataatttgggcggccattagcgcaccattcttagcccccgcatcaccaatcgccatcgtcgccacgggtacgccagctggcatctgtacaattgacaataacgaatcgactccgttcaacgtatgggtcttaatgggcaccccaattaccgggagtagtgtattggcagctagcatcccgggtaaatgggcagcgccccccgcacccgcaataataacttgaattccccgtgacgctgcttcttcaccataggattgtaatgtctggggcattcggtgggccgaaataacgtgacgctcataagagactcccagtgccgttaactgttctgccgctaattgcatggttggccaatcagaaattgaccccataatcaaaccaactttcgccatcatgatccctctttccctgttttcaccattagtttagcaaccagacggttcgctgtcaacgaatttcttaactttatctattaattaacgttttaatgttcgtgttaatgaagttgataattagattaatttcaccttgaaacgtacgaacaaccccactatttgcaggtttgcggtgcatataaaaagctatcaaatgatttcaatcgactatttcgataatattatttatattgaaattcacgaacaatacgtcattatctaagtatcgccatgacacacttaccgctaccatcatcaacagctatccgttgaaccgggcctttaccttttgccggtgcgccagtaattaacagcaatgactggaaatcggcgtaggtcaatcaactatgcaggttgacgctaattcaaactatttctagcagggctaaatcggccgcgattgaacttaaaaacgaccaaccgtttatttcgcgaacattttcctaaatatcggattgaagtaagccaaatagcacaaaaaaagtctcgaggaagcgattcctcgagactttttcgtacactagttattttgctgaagcgcctgaaacactgtcgacatcaggtgttgccggcttggttggtacttctggtgcggcttccgtatcggctgaagcgccggagacatcatccaccgctggggcagcatcaggcttcgtttccttcgccttcgatgaagctcctgaaacggcgtccgtcttagcatctggatcaggtgctaacatctggcccgtctgcttcaggtaatacttcacgattggtaagaggtcgagcacaaactcgttgatacctttgtactcacccttatcgtcatgcaaagcttggtaatagtgcatgacatacttattcggaataccaggaactggcaacttgaagaggtcagtctcaccggtccgtagcatgtgtaccgcccgtttaacaccgggtacggcccgctttggatgacagtcagctagtgggttaccggcttgagccggtgtccgtgaagctaacatcttgtcgccatccatctgatggttataatataagaattggttattggcatcggcatacgtcaattccatcggcatcgagttgaggaaccaattcaattggttgacggtcagcacaccccggtcgagcttaacgtagtcgtcaccctcagccgcatgggtcttggcagcggcttgttcgacccaatcagccgcatgcatgttaacacccttgatcgtcgtttcgacttcgcccttcgcttcgaggtcttcattcttccagtcatcagcgtgggcttccgcgtccatcgcgttgaccatcttgacaaacttcaggaacttacctaacgtttctcctaaaaatgaaacggtccgagcatctttcagattgttttggtcatcgaaagcctgcttaacttcaccgagcaaaaattcgttgccgggcatgaccacggcatctacaccgggtgactctaaaatctggcgaagattcaactgcgcccgcgatgaaccttgatcatagtatgaagcacctacgatcaagacgggtttccctgacatcgggtgaatcttgaacgacaaccattcgatcacgctcttgagtgcggcggtaatcgtgtgattatgttctggcgtcgcaataatgaccccatccgcctgcatgatcttccgcttcaaatattgaacggcttcgccttccgtttgatcgtcactctgattaaacattggcacatcttgaatatccaaaatttcaatgtcaaccatgtcactgaaatgattggcaataaactttaatagtaaccgattataagacttatcttcaattgaacccgcaattccaactaatttcatcgtcgtcgccctctctataatttttcccaatccatttcgcgcacttcttcatacgtcgtcgcgttggcgttctttaattttttcgtgatttcaacaaagatttggaaatccttgaacaacccatcgagcttcgttaccttctgttcatccgttagattaccttcgtcatcaaaggcttgcaatgaatggccaagcatgaactctgaacttggcataatccgcgcccgtaattctggtgaatccaagacttgccgcaggtgtgcttgtgcccgcgaagtccccagcgccccgtatgaggccccgagaatcataacgggtttgtccacgaatggttgaatgtggaacgataaccattctagggcgttcaataacgcggcgggggctgaatgatcatactctggtgtactaataatcacaccgtcagcttgttcgatcttgtccgccattgcttgggcctgcgccggaatttcatgattctctggcttattaaagatgggcaagcctttgatttccattaattcaatctctgcttgatccgcatagtgggcctgcatatattgcaacaacttacggttggtcgattcatctgaattggttccaaccatcgcgataaatttgtgcattgagaacaactccttctatggtcaaatagtcaaatattatataatttcttagtcaataactatattgtaatggatttcactaaagaaagcaaaacaattttaagcgctttcacttttgattaacgaacaactgaactcactgatactaagcttatccacttaatcgagtaaatccagcatccgaatgactgcatcgatattccatctgcttaacagattttttcacaaagctatgacgccacaatcaggtcaatcaagtcagcgggtgcaatgcgcccaaagtagcgagttaagtctaacgacgctaatgccgttgtaatcgcctttcggtcatacttcacaccagttagttgtgcaatgaccggttcaatcggctccgcaccgaagaaatcaccataaatcgtcaccgtttcgatgcgcccagccaccacgttcaactgaaactcaactgtgccagcatcaaagtgccgacgctgcttaacggtaaacgctggtgactggccgtagatccaatcccagtttttaaaatactgctggtttagtgcggccaccccagcccgcgcggtgtcgtctaactgataggtcttcgcctgactcagatcagttacacccaggatttcacgagccagcgtatcgcggaaagcctcaatcgtcaagttctgataggccggcgccatgtatggtttcaagttcgtgacccgacttttgaccgacttgatgcccttagaggccaacttgtcgctcggcaccgtgagggctttcgcgatttgcgtctggtcaacatcgtacatcaacgtgccatgggaaaacatccgcccattctcaacatgcatggcattacctgagaatttcttgccatcaatcagtaaatcattacgaccgctcatcgtcgcaccagtggctcccattgcatgtaaagcctttaaaactggtgctgtaaaccgcttaaagttaccgaagccgtcgccgtcatccttagtaataaaactaaagctgacattgccaagatcatcataaacggcaccgccacccgaagtccgccgtgtcaacgtaatgtggtgagcatcgacataatcctggttgatctccgctttgacgttttgataacgcccaacaatgatgcagggatcgttaatataaaagtataaaattggctccgtcaaatcagcatgttccatcaagtaagtctcaatggcgagattcgtgcgaatatcatgactggagcttgcaagatagcgcatcgtcacacttcctattccaaataaatccgttgcagatcattaatttcattgttagttaatttaagttcagtgtgtaaatagtggtttaaattacctgattgtcgtttaatttcagtcatagcggcgtccaaataagctgggtcaactgaccacaatgcccggatactttcgaccgttgcagcggaggccccttgggcacgtgcatcggccatcgccccattgatgcggccaactgaagcctggttagttaagagataatcttgcttaattgtctcaaaatcaaccccgagcgcagttaataagtacaccgcccccattccagtccgatccttccccgcggtgcagtggaatagtaacgttgaatcgggttggtcatttgccagcagattatcaaaaaagcggcgatattcgtccttcgcatgttgctcgtcagcgaccattcgataaacttttagcatgtgtttgaacccactgtcggggtgtttttccaaattcgctgtcatcttatcagtaccatctgagtttcgcgtctcgtcgacgttgaatactggtgcgtacacgtacttagcgttagcgggaattcgatccggcgcgtctaagacttcttgtggggaacgaaagtcgatatcataacggaccccatagtcatccagtaaagcttggccagcgggggttaattggtcaagtccaccagtacgaatgaccttatgccacttgatttttcggccgtccttagtcgagtaaccaccgagttcacggaaattgataccacctggtacagttaatacacgttgatttgtcattgttgaagccacctatctgttaacttttcattctctattctaacattatcagtgagtctaccggtgactcaatcaccgaatcggtcgctttatttccagaattatctattcgcatcaccggcaccaaccaacattaacgcgtgctataatgtaagttgcatggccagcacgacccgcccgacttaagcaatcgtatcattggcggctttgttgccaattaagatgacaacttgggcttaattagacgttcggccaattacctgaaggaacacccgttggccgttttggtcgctgacactagttccagcactgacaccaagtacacgtaactaatcactgagtaatattaatggaggacttttcgatgacatttgactacgcacaccaaactgactgggctatgactagcggccaacatcagtcaccaattgacattcaaaccgaacacacgcaagcttcacagctatccgctatcagctggcggggcttctaccaagcacagacgattacgggtgaagcaacgaccatgaaggctagcggcatcggggccgcctatttgaacgaccgcgactttaactttcaacaaattcactttcatacaccagcggagcatctgattgacggtcaggccgcgccgatcgaatggcatctcgttcatcgaagcgccaccggccaactcgccgtcgtcgcggtgtttggacggattggcaagcctaatgctagtttacaaggcctacttgaccagttcacaccccaaacgagccatgaactgacaacaccggtcgacttaactgaactccttcctgataccgggacggtttaccactacttgggatcattgacgacgccaccattaagcgaaaccgtagaatggtatgtctgcgccgacacggtcatgattggtgaacaacaattagccacttatcagcaattatttgccgctaataatcgcgagattcaaccattaaacgatcggccaatcattgctgaacgtttctaaataattctaatggggtgagctgatgcctaagaaggtaatctggggcttaattgcaagtggcctctttctcttattgattgtcggtctcggactgacaacacaaattcaccatgacaaggtcggtcacgtcattaccgctcaaaaacggccattgatcatgattgcaggtagtagtagcacacgctctgactttgatgatatcgtccgttcactcaatgagcaacagcaccatccgctcatcaccctgaccgttaaggcgaaccaacaactggaatttagcgaaaagcgcgtcgaaaacaccaaccttaatgatgcgctcatcgtgatctttttcgaaaacagtgctgattcaacggcgaacatcatcacccaaacgaacggcttagataaagccattcgttacttgcaacgtcatcaacatctgacaacggctaacgcactcggttattcgaacggcggcttgatttggagtcgctatctggcaggcctgagttcgtccaaaccgttagcagtccacgatttgatgttgattggcaccccttttttgggtaccgatgccgcgcatcctgataagacgctctatacgccgcttcttgatcacaagagccagttcaagaaactccatgcggtcattaacattgcgggtgatactggtgagggtaacgacgatattgtcccgctcagtagtgtcaacgccggtggcaacttatttatgaacaacgccacccgctacaccgccatgactgttaaccaaaaatcaatcagtcacggcgatctactccacgaagcgtacgtcgccaggctcattcgccaaaacttaatcaatcaatgatattttccatatcatctaatcaaacattcaaaaaaagctgagccatccttccttgagaagtaatggctcagcttttttgacgctttatggcgggttgtcgacgccaccagctttcaataccgttaatcagcttcatgcacaatccgattatttgtggaccggggcccagatgcggtgctgaatgtcatcatgaattggcagtcgctacaaatcgagccagctcatcggtcgacatccccgcactaacacccaccagtaacttaattcgagctttttgtccattcaatccctgacaaaaaatcacacccatttgtttcaattgaacaccgccaccttcataggcatagacatcctgagcgataccgttgaaacaacgagaaaccagcacaactgggatctgcatgtccaataacttttgcacagctggtagcgtggccggtggtaagtttcccgcccctaacgcttcaatgactaccccatgagtcgtgggctgcgcaatagcgttaaatagttctggtcccatcccggcatatgctttgatcagaaagacattatccgtgaccgtttgaatcgggcaaaccgttgaccgtaataatgattcaaaaaagacaatgcctttattagcgactaacccaatcgggccaaaagttggtgttctaaaagtggccacgttggtcgtatgcgtcttagtgacgtagcgggctgagtggatttcatcgttcatgaccactaaaacacctttttcggccgcatccggtgtactagccgtttgaatcgccgtttcgaggttatgcaggccatccgagccaatctcattagcggaccgcattgctccggtaataacaacggggagttcattcggtaacgtcagatccaaaaaatatgccgtttcttctaaagtatccgtcccatgagtcacgaccaccccatcgaccccttcgtgtgcagccttatcgatccgttgctttagttgcaacatccgtgctggagtgatgtgcggcgacggcacgttaaagacgtcctcggtctctaattcaatatccgtgccaaacgaactctgataattgtctaaaggattttcatcgccgggggtcacattgccggattcatcagccgacatcgcaatggtgccaccagtgtgtaataccaaaatcttcttcaagtatgctcctcctcatcttgtcacgtgcctgcgcacatctaacagtaaaattattttaggcctgccaccacttaattgcaatccaccctcactggttcttcatgtcagcttccttagattctcatacaagcagtatcagcttcactgaatcgactaacgaagcaagcgccattcgaccgctttaccgcaacgtagcaccaccctggcaaccaaattagcccttgccacgattggcacatgaccactaattattcagcacggttgttagctcgccacatcgtcagccgattggtcagttcacacaccggtgagttcgttagtcagttaatcacctattcggtgcgtggtaactaaccacagcgcaccaacttcatcaagtttagtcgcagaggcaactaatcacccatttgacaaacgttgatagaccagcatttgatagcacaattaccatcaaacaagaaaataatgtttgacacagccgttagttgcctttatagttagttacataagtaattaaccaaataacaaaccaactaactcaagaggggtatttaaaaatgacaaccacaccaatcatgaccgtcagtgacctacacaaaacgtatggtaaggcgggcagtaaacaatacgaagcgttaaaaggcattaacttcaatgttcaaccgggggaattcgttggtatcatgggcgcttctggttcggggaaaacgactctgctcaacatgctagcgacactagatcgccccactagtggtgaagtgaccatccatcagcaaccaatcacccatttaaagggcaatcaactcgctgattttcgggctaacgagattggatttattttccaggatttcaacttattggaaacaatgacggcctacgaaaacatcgccttaccactgtcactgcaaaatacgccggccaagaagatcaagcccgccgtcgaaaaagtcgcccaacaattgggcatccaagaatttttgacgaactatcccaacgaattatcgggtggtcaaaagcaacgggtcgccgcggcacgggccttaatcaacaatccggccattctattcggtgatgaaccgactggtgcccttgattccaaatcagcccgcgaattactcgacttgtttaccaaaatcaatcaagaacgagccgtctccatcttgctggtgacccacgacccattctcagctagcttctgtcaacgaatcctcttcatcaaagatggccagattggccaagagctccgccgtggtgagcttagccgcagcgacttttaccaacaagtacttgataatctggggacatttgagcagtaaatcgaacaaataaaaggagcgctttaactgatgttaactaaacttgcaatgaccggcttcaagcaccgctggcgtgactacctggtcttattctcaggcctgatcatgtctagtgccatcttctacatgtttgaagccctcgcaaccaatcaaagtttcttaaaacaaaatacgagtattagtatggtcggctttatctttcaatttggttccgttttgctgaccatcatcaccttagtctacattggctatgccaattcattcttgctcagcatgcgtaaacgggactacggactcttcatgctggtgggcgcgcgtaaaagtaaaattggccagttgatttggctagaaactctcctcgtgggggtcgccgccacaatcatcggtatcctagtcggcacgctattgacggccggggtcagtcacctattggtcaatagcctcggattaaccatccggcacttttccgcctggtatactcccgcagcgatgacgaccctgcttggttacgtgggcttattcattatcgctggactattcaacctgttggccctaaccaagacacctgctttaaaattactgcatagtaacgatcaacccaaccggccccaactaaagccggcacggcaactccttgaaatcgtaattgggttaatcgccatcggtatcggttactggtcaatggcccacctagcgacgctccaattaatggggatcggtgtggccctagtgacgatcgtattaggcacctacttgttatttaacgccatctttgtttggctaatggtggcactcaagcgcttgccatttgcacagcggggtctgaacggcttcaccttgtcacaattaagcttccgcattcgcaattacaccaagatgctatcaatcgtcgcgatgttgttcgcactgtcactcggggcgattaccgttggaatgggctttcatcaacaaatcccactgatggctaatgccaacaacgcctatgacatggggctcgtgaatgccacgaccgccgaacgtcagcaaattgccgccatgaagcctaaaaccaacgcgacgtatcactttaaagcgaccaagaaagccgtttactaccaagctgctgaatttaatcgcgatcccttcacgacgattgaagtccaggataagcatcagttgacttataaagcggtccaaaataaggccgctaaattgcagcagtcaactagtaattatcaattaatgcaactaaaggatggcgtcatgattaccgcaacaccagtcttcttgtcaaagacggcttacgacaaggtcaatcagcctgaacaacgtttgaccgtctttgcaactaatagtgtgattacgcaccgtgctgcgctgaaaaagctcgcgaaaagtcattttcataccgctaatcctgaacgattcggtggccgctacgcgatgtatcaaatggtcaatagtatgtactccggactcgaattcatggggatgttcttaggaatcgcctttctagccatgttagccagttgcttgatgttcaagattctttcgggagccgatgctgatcaacaccgctaccagatgctcgacaaagttgggacaactaaacgtcagctgaaaggtgccatcaataaggagattgccattctgttcattctccctggcatcgttggtatcgtgcacgttctattcggcttgcagatgttcaaactcatcatgatcacgtcaccttataccggtatttggctgccgtttgtcatctttgccggtctctacctactttactatctcattacgatcaccatctatcggcgaatcgttttacaataacctttcggaggagggaaaaatcatggtatactttggattagtcgctttattaatcgttattacaccattacaccgttacgtgctcgcaagtcgtcgtcaattctggttaggggcgctcatgccgcttctgtggctgagcgttaacttcggtttagccacccagattatctttgaacatcaagacattctactggccgtactgggcaccctcctcctactctctagttggattgctgcccggattgatcgtaccgaacgacaactgcaccagccgcaacaaaaggtcacaacgaaatagggcaatcactgcaatgaggtgaataaaatgcagttcaactttaatagcacggaaccaatctacttgcaggttgccgaccaaattgaagaagctatctttacggaaaccttcgctgaaggtgaacaaattccttcgacaaccgagatttctaaagaatttcatattaatccggcgaccgtgctgaagggtatgaacatcctagttgatgcccaattaatcgaaaaacggcgcggtgtcggcatgttcgtcattacgggggcccagcaccgaattgttgagaaacggcgagatcagttttacaccgattacgtcaaaaaactagtcaccgaagcacaaaagctccacattacacaagcggaattagcaaaattaattgaacgggggttttccgaatcatgagtattcaagttcaggctgtccagcaggcctttcgcggtcaaaccgtcctggataatctcaacctaacgatcaaaccaaacacgatttacggcttactaggtcgtaacggtgccggcaagagcaccttgctgaacatcatcagcaatcgaatctttgcggatagcggaacggtcaccatggacaacgaaaccatgcgtgataacgaccacacgttaggaaaggtttacttgatgagtgaagttaacctctattctgagcgttcccgagtcaaacaactgtttaaaaccaccgccctactctatggtgatttcgatgacgcccatgctaacaaattagcacagacattcgggctcgatttaaacgcccgctttggcaaattatcgaccggttaccgaacgatttttaaactgattattgcgctctgtgttccagctgactacatctttttggatgaaccagtcctcggtctggatgctaaccatcgcgaaatcttctatcaagaactgattgaaacctacagtgaccatccccggacattcgtaatttcgacccatctcattgaagaaatcgcgaacttgattgagcacgtcttcgtgctagacaatcatcatattattgtggatggcgatgtcaccgacatcctaggacaatcttacgcggtaactggcccacaaactgatgtcagcacttatacggatgatttaaatattatcggcaaggatcatcttggcggaatcacggcccactacgtttacgggccattagataacgaccgaccaattcctgatacggtcacggtcgagcatctggacctacaaaaactatttgttaacctgactaataccaaggaggaggccgccgctcatgtcaattaaggttcgcaacaccacccgttatttattaacggaacaattgaaaatgacggggtggtcggtactcgcttgtgcggtggccttcggcatattaccactgttcttcgcattcatcagtgacaatattagtcaatactcgccactgagcaacttcgccaatctcagtcttagcgccctatttttcatgataatcttcatcactggggcactcacttatgactactttaagctttttattcaaagcgggatttcccgacaaacctactttcaagctcgagtattcgcattactcatgcttagtggtttgcttgtcatcatcaatgccatttattactacggtattcatgctccgtatttacactggagcaccaacaccgcgttgatgagaacgggctattcgctgtatagccatgcgctgggaaatcaggtctggctaaacattttagctagcttatgctttaactggattttctacattggcgttggccttaccggcatcgcttgtgggaccttactcgcgttatttggtaaatgggccaaaacgattttaatcattggcactcccatcattggcatgcttattatttggataatggtcatcattatgactcgcaatcaatcgaactataattacacggggcttgaaaacttcttgaaatttattattggttatcccagccgcggtgaagcgacaactggttactttaacccaaccatgccattcatcacaatgctggtaggttgcggtatcatcggtggtctcgcttatctgttcaaccgtaagttaagaatcagaaattaagctgataatctaaaaaatgaagcaggtcgtgaagttattgacttcacgacctgcttcattttttaatggttaatacaaacgtcacaccattcgagaagtggttttcccactaacgctacttttcaacctgcgtattttgcaaatccgtcttaaccacgattacatcagtcaacgcattacgctgcacatacgttgtaaccgagccttccagcacgcgttcaacggcatttaacccggttgcccccatcatgatcaagtcattatgatgatccttgacgaagtcctgtgaaataattggtttcggacttcccattcgaatgtggaaggcaatgtccgtaaagccatcctttttgacttgatcaaccgtttcttttaaataagcttcagaatcctgaaccaattgatacgtaatatcaccatccgccaaaccagctaaattatacccaaactgaccgggatcaatgactgctaacacgtcgatatgtgcctcattacgtttggcaactgcaaccgccttatcaagcgcaatctcagcttgttgtgagccatcgaggggaactaaaatattcgaatattcttgtaccattgacgtcacgccctttccatctgttaactctattctaccatttatcagcgttggttgcgttaccatttatataaaccgacgaccaataccagttactcgcgggggggctcaccaggccagacaagcggatttacacaatatttacaacaacgacatctgaactttacagttgccccttacaattggaattaatccacttgggggtgaatggtatgctttctttaggtattcgaccaggtctaattactagtcatacaattgtcattaacgataccctttcatatcaagtccgcttaagcaaaggacatttcgggcctgatcattatcgcctagacgtccgtgcgaccacgacactaggccaactgaccgtgctgcacacctgctaccatgacttgaccgcggctcatcaggcctttgagcatcagtgccaccaacttcaagcccgctaaaaatattcaacactcagctgtttaatatgataggatggtacctagtactaatcagctaaagtgagggtatttatctgtgggacaacttatcaaacaactctggcaacgctatcaaagcgtcctctcctatttaatctttgggggcttaaccaccctaattaatattattgtttttggcattttcaaccaattctggccttactggattgccaatacgattgcctggcttctctcagtcctgttcgcgtatatcacgaataagatttgggtgtttgactccaaaacaccaactttccgcgcggttatgcttgaaatgacgtcattttttggctttcgcctactcagttactttattgaccaaggcattatggttgtcggtatttcagtcctgcacggaaacgacctcatcgtcaaattaattgatcaaattatcgtggtcttactgaattggttcttcagtaaactctttattttcaaagaccggggccaccaaaactaaccaattcaaatatccaaataagcgccgccggaatgctaaccattccggcggcgcttattttatcgaccacattgccaattcattattttctgacacttaactttcagttaacactattcttgtggacatggctttcacccaaactggcgttgcaccgtatgtaacgtcgctaactttgtgaccacatcatcaatattaacaccatcccaattatagaagatgtactgacgaccacagcgcatcttaatcactaaatggcgcgctgatgatgcatacccattgcggacctcggcctgatccgtcgtcagcgcgtagtattgaatatcatccgcattcaagactaactcgccgattcgtaccacgacacgctgattgatcgtagtcggcggtcgcacggataagcaggacccgtcatggtgctgatatcgtaactgcaccgcaactaaaccggccgcggtcagctgcggactaaaataaaactccgcaccaacatgcaacgcacttgacggccaaactgcggatagtcgaaacttaaaatgccggccatgaaaatcggtcaggatgccttgatcgtaatccggttgcattgccgtaatatgcccaatcataatgattcactcccttcaattagttattgataatgtatcacgcttcacaagcatagttgtaattaaagtccacaatcgaccgtttttggcgttttttattaaaatagtaattaaattatccttactcatgctaatatttgagttaactaactttatctacggaggtctcgttttgacgacatttaccaatcaagaaactgattatctcatgaacctactaaccaaccaattaatggccctattaagccgcgtcatgcgctggcagacccatagtttgagtcaacaacagtacgaccaacaagtgcacgagacactgcgacccgaactgaccatgcttacagacatcactgccaaactccaagaacaggccactgacccaactcagcttggggccattcaagcaggtttgaagaaacttcaagtcgccaccacctatcagttaactgccgaccaacttggacacgctaatgaacgccggttaaatcgtcggtatcgcagttaaattgcgcaacttaggcatattggccacgatattcaaaactatttcgtaatccttaacagaaaattcaaatttcaatcacgagttagctactttttctcggtacaatggttttatcatcaaatacaaccacttgaccgaaggagggcttccatgttcttaattgtttattgtacgttcgctattgcggtttttttctggatattcggttacgttaaaaccgccgttatcatcggtatactggcactgagcttgattgcttactccttcattcgccgagaaatcgcacgacggcgtttgctcaagcggcgcacggtcaccaataaaagtcgataaaaaattccaacacgctggtgtcggaatttttttgattatttttgagtttgtgataaacaagtgacgattcgctgtgctgcctcacgcacattttgcggatcagtcgctaagttcaagcgaacgaagccctgatcatccggactaaaccactcaccgaagtctacagcgagctgacatcgatcctgaataaaggctttcgtttcagtcggctgaacatatgcccgtaaatccagccacgtcaagtacgttccctgtaaatcagccaaaaccaatttcggcgcgtgggccgcaaaggtggcacgtaaataatgataattatcacggacgatttccagaatctggtctagccaggccgcccccgattcataggccgcttgaccggcaacctgtcctaagacactgatttcagtctgactgaagcgcccgatttgtgcatcgtagcgttgtcgcaattccggattaggaataatcagatgtgaattcaacagggccgcgagattaaacgtcttagacggggcattgacgacaatcacccggtcactaaagcgaccattggcgatcgtcaacgctgatttgaacggatgattagcccgatcaatctctaaatcttgatgaatctcatctgaaatcacgagcacatgatactgttcacataatgctaacagccgcgtctcttccgcttcagaccaaatccgccccacgggattatgtggcgaacattgaataaacaaccggacctgattcgacttaatctgccgctccacatcttcaaagtcaatcgtatagtgaccatggtcattctgtaactcggacgtgactaactggcgatggttgtcccgtaccgcattgaagaacggataatacacgggcgttagaattaaaacgccatcccccggttgcgtcaaaatattaacgagcgcgtacaacgaattgaccaccccactaccaaaacgaatccaatcgcgttgcagtgtcaggccatggcgcgtctgctcccaatcaataaaggcttgataataactgtcgggtgtaatggaataaccatagatcccatgtgcgactcgttcttgcaatgcctgcgttacttgctccgggaccttaaattccatgtcagccacccacattgctaacaaatcagggttgccataacgcgcctgtagcgcgtcccacttcaatgaatccgtatgccgacgggttgtcccgtacttcttaataaatgctgcttgttccatcttaaaggccttctttctcaacaaaaaaacttcgtccttaacttactaaggacgaagtttttactccgcggtaccacctacgattacagtctggctgtcactcacgcaacgtactcgttacgttcaacccgtttatcggcggtcaatccgggctaacagcgtcaaccgttaaccaactccgagttcatcttcacgctaagctaatggtcaaatcacaccaatctttgactcgctgggcaccagcttaacactactcttctcatcaacatttaatcttcacgttgtttctaagttacaacgtgccgaaacaaaagtcaacagcgtctttaaaattgcgtttgctctagaatctgatagccatcgatacgttgttcagcagttgggaacgcaccggtttgtaagaagcgcttggcctgcatgacgcgcggcgaactattcgcccaattcaattggtcaagcggcacccgtgcagccccggccgacatcgcttcagtgaaatgtggtcgtttgagtaacaagtgcccacccactggttctagtaaataatagatattaattaacgttgctggcaagtctaatgtcgttaaggcgggaatcgtgagttgcacggccccgagttgcttggaaataacggtttgtagtcctgtttgaagttgtgcgatctgactaacggcctcactcaacgtggcccgtgtcgtcactggtgcggttactaaatcataacggttcttgaacggcccggttaaagatttattcagaaccatggccgtcgaatcaccaatgataccacaaacaaatagtggactacttgctggttcgttaatcatcaattttttccttctctcagtcatacgattaaatagataaattaattagcctataaaaatataacagttacattttaccgtataatggcggctagtttgctaaaaaaagcatgctgatatgaatatttaacaacttttaataattctatgaaaaaaatcgaatcttggctactaaaacgcacaagattcgattacttttttgccactatttagttagattgcacatcggtcgtattgataaacgactgtgccggcacgcgaattaaccagcgcgtcatcgcctgatgaccaacatggacacctaagccattccagaatgacggccggtaagtagccgttaacttgactgcgtaggccttttcatgctcccggtcctgcttgagtaattgcttttgtgaccatggaataccagcgtccgccacgttaacttgcgatagattagtcactacggtcgccttgttacttgaaacggtatatttcgcaccgttaacccagtaattataaatatgcacgggtttttgggtcgtaccccgatcgaccgcgacatagtaggagccattcgttcccacgcgcaagactaatggttcgacttgatacgttaccttaacgtccttagcatctgacaggtcgacctggtgattgaaagtcacgtatcccatgccaactagtaatccgagactaacgattaattcaacggtggtaatgataagatttccccactcaaacgtatgcttacgttccacgatcatcttgatgcgtcgtacgcgaatatgatgaaatacccacacgactaacgccaaaacaatgatccacgcaatgatcccaatccaattccatgcagaagtcattgattgccaaccctttctcaattacattattatgttctaattgtaaataatccaaccttaaataacaagtaatccagcaaattcaacacaatcattcagaagcagattgtgaaaataatcactgaaacggtgccaatgtaatcgaattcatggtaaaataaagttattaacttgtagaaagaaggagtacacatgatcgcgtcactaatttattgggtcgtcgttgttggcttgattgtttggggtgtttggatggccatcctttccgcatattgggccagccaaaaacaaaacggcaacattttctttattgcaattatgaatacattaggtgccttggccggcctcttagtatggtgggtcttcaacaatcaagactggcagtactactggttatccagcaccgttaagacgactaacctattaggcatcgtcctaatctgctacgttgtcttgattgtcatcgaattcatccaaggccggggcatcaagcctgaaacagctaaataatgatgatgttaaacgccaagcaaattgcttagcgtttttattgtcaaatggggcattcatcttcctgtcaatgtttgttacagtgctaacaattaggtaggtatgcggcatgctttgcatctcgttatcagccgagtttggccgttccagcgattatgtccggtgactaacccgaagctaattagcagcgcattcttcatcatgcttcgtaaaaggaacaaccggtacaacgcgttaagcacaaagaaacgattctcaaagatattgagaatcgtttttttagaaccgtcttaatctgtcgctaatcattgggccagatcagacttgaatacttcaattcgagtgcgataaacattggcggacaaaacgccccaccagtccgctagtcgtgttgcgtcacgactaaactacggtcagttcaaagccccccggtgccacttcatctgcagcaactcccgctgttaagattggcgaagcgtcacttccggcggagactgcctgggtacctaagttaaagcggccttgaatcgtctgttcaacatccgtccgcgttaagattaagcagtgaccatcaatcgtccatgtcaattggctagttgctaaaaagtcggcctgttgccggcgaaacttgatcaaacgcgtgacgaattgtcgaacttgttgttcttgctcgtctggttgccagttcatgcaccgacgattgtcagggtcggcgccaccggccatggccacttccgttccataataaatacacgggctccccggcaatagcatcagtagcgtgagggctgctttgaacttagttaactgtccatgcaacgtggtcagtagccgtggcgtatcatgcgtatccaacgcgttgaacatcgcctgttgattaggttgacgatacatcattaattccagattggttttaccaacgtaatcttcaaggttgagttgaccattaaacaacgccagaattggttgtgtcagtggataattcataaccgcgttaaactggccgttaccgactaacgattgactactatgccaggactcacctaataggtacacgtcaggtttgattgcccgcaaagcaccacataacgctcgccagaaaccatggtcgacctcatcggccacatcaaaacgccaagcgtcgattccgaattgttcgatccaatatttggtcacatcaatcaagtaagcttgtaccgcggggttctgggtgttaactttcggcatcgctgcccccgtcgcgaaggtttcataattaagctgtttcgtcttcggatcacgtcccaccggccagccatgaatatggaaccaatcagcaaaccgtgactgctggccatttttaatcacatcttgccactggggtgactgctcgccaaaatgattaaagacggcgtctaacatcacgcgcataccgcgcgcatgggcgccatcgactagcgcctgaaaatcggctttcgtaccaaagtggggatcgatttcaaaatgatcgatcgtatcatacttatgattagatggtgacgtgaaaatgggacacaagtacaggccattgacccccagtgcagccaaatcatctaaatgcgctgtaattccgggcaaatccccaccataaaatgaatcacggtgaacacgcccagcaccccacggttgaacattagccgggtcattttgccgcacaccatttgcaaaccgttcaggaaagatctggtaccagaccgtctccttgacccatgccggtggcagctccgcatcactgacgtgcatatatggcatgtgaaaatagttgcccaccgtttgccagttagtggcaacgtcgtcaaagaagccaccctcaccatagccaaccgtcgcaccggtcgtatccgtgatcagaaaggcatagaccacccggttagtcggtacggtcagcgtcgtctgccagtactggttgccctgcgtcgctaatccgggctgcattatccgccgctctagcgctgttgttccttcttgccataagtaagaatcggcaaacaaaatctccacttgggcaacatcgtcacgcgcagtttgtagtcgtacctgtagttgatgtgcggctaagacggctgtatcttcactttcagggcggtgcctaattccagctagttgcattgtaagatctccttttgtgtaaacgattacattattaactagaccatttacgtcaattatcgtcatgattttggtgaaaacgtccccgttcacctcgattttagtgtatcatttagtcaaaatcagttgaaaggacgttatccatgaaaacactttatcgcagtacccgcgaaactgcaagtcacaccatgacgccatcacaagccgtacttcaaggcctgacgccggatggtggtctctttgtgcccgtaacgctaccgaccgctaattttgacttcgaccagctcgccacgatgagctaccaagaagttgcttacgaggtccttaaactcttcttcacggattataccgctgatgaattacacgcctgcattgacgcagcttatggcgatcagtttgatgacccccaaattgcaccggtcacgaagcacggtcagcagtattaccttgaactttttcatggaccgaccattgcattcaaagacttggcccttcaaatcctaccgcatttgatgacaacggcagttaaaaaaaaccatttacaagccgaagtcgttattttagcggccacttcgggcgatactggtaaagcagccatggccgggtttgccgatgttgatcagactcgcatcatcgtcttctatccaaaagatggtgtcagcgcaatccaaaaacagcagatggtgacccaaaccggagccaatactagtgttgttgcgatcaacgggaacttcgatgaggcccaaacaacggttaaaaaactgttaaacgaccaccaattgcacgcgaaactagccgcccaccagttccaattttcaagtgctaattccatcaatattggtcgtttattcccacaagtggcctattatgtctacacctacgcgcaacttatcaagcaggggcaaatcaagaacggtgatgagattaacttcagcgtcccaactgggaactttggggatattttagccggctactatgccaaacaactgggcacgcccattcataaactgatctgtgcttccaatcgcaataacgttctcaccgatttctttaataccgggacttatgacaaaaaccgtgaattcttcttgacgagttcaccgtccatggacatcttagtctcaagtaacttggaacggctcctcttctacttgacaggatcagacgccacggcgactgctaaactaatgactgatttgcaaacgaccggccgttatacgattacaccggcaatgcgtgccaacttagctgatttttgggccggcttcgtgactgaaagccaagatcaagctgaaattcatcacctgaaccatgcccatcactacacaatcgatccacatacggccgtggcctcggcggttgccaaacagtatcaagccgcaaccagagatcagcggcccatggtggttgtttcaaccgctagtccgtataaattcccacaggccgtcctaacggcaattactggtgagcttagtgcggtagatggtctagccgcagttgatcagttacatgagttgattcaaacacccattccagcaacggtcacagccctccgtactgcgcccgtgcgccataagcgggttgcggatgttgatgatatgggaacgaccattaaaacaattttaaatcttaactagaaagtgtgaccaagatgattacgaccattgcgttagacctagataatacgttattaacttctgagaagacgatttcgccgcgaactgaaacagttctcaaacagctacattcggccggcaaacggatcgtactgtgtactgggcgaccaattaaggcgattcaaccatacttacaacaacttgaactcaaccaaccaactgactacgcgattacctttaatggtgggctcgttcagcaaaacacgactggtgacgtccttgctcgtactagtgtgaccaaacaagatttacaacccttatttgagcaagcccagcgcgatcatttctacttagacgtgattgatttgaagcaagtctactccattacggatctaggcaagtcaccgtacgaagaattcttgcaaggcttaatgccatttaagaatgttcgttttgccgacctgcctgctgatgatctattcggtaaagtcgttagtgctggtcaagatgctaaaacagtccaggccaaattaccaagtcaaattaccgatttcttccacgtggtcccatcccggcggactttgttggaattcttaccaccgcatactgataaggccagtggtttgaaacaactcctcggtcactttaatgaagactatgacaacttgatggcctttggggacgaagaaaacgacctaggaatgctgaccgccgccaaagttggcgtagcgatggcgaatgcgattcctgcggtcaaggctgcaaccacccatgccactctgagtaatgacgaggacggggtcgccgttttcctagaaaattacttcaactgatctccaactgaagcctgtaacgggcttcttttttagcacaaccactcaaaatcaaactaacgaggtgtcccatgcaagatccccgcattatcccagcagaattaacgactggcgcttttttcgatattttagcagatgaggaccacagcttaagttatattcaggttagtgaagaagacgtgagtcaccagcacatcgatcaccccatgctggatcacgtgcacttcgaaaatgtccggtttacggccagtcaatttgaacggcttgacttgaccgatgctgtctttatcaattgtgacttttctaattgccagtttgaaaaagccagctggctacgcgttcaattcaaagattgtaagctcgtcggtgtcgacttgaacgaggctgccctcaataacgtcgcctttgaccactgtcagctcgacttagccatgctgtgcgacatgcggttcaaaaccgtgacctttgatcactgtcggctgaatggggccagctttatgaacaatcgactaacgaccgtcaagtttaacgaaaccaaccttgaccaagtcgctttcaacgataccgccctcaaaaatattgacctaagtacctgtcaattcgagcgtctcgaacttgatactgccgcagcacgcggtatgatcgtcaatattgatcaggctgcttatttggctgctgctttaaacggcatcaaagttaaaccctgataccggtggaacagtcaccgtatgagtgaccaactcacaatgccaaggacgattaagctgctggctggtaaatcttctaataacactgcacgtatctgtcagaatacttttcacgcgctgaacacaaaaataccacctccgtcaggtaacaacctgcgaaggtggtattttgtcgttcatcatgacaattcgaattgcgccccggtgtaaccagtgcggtcggccgccgtgattggtcgaatcacttggcaagggttgccagccgcaatcacgttagctggaatatcgtgggttaccacgctcccaccaccaataatcgtgttagcaccaatggtcactcctggtaatacggtgacgttagcggctagccaacaaccatctccaattgtgattggtcgggcgatgcagccgcccctaattcgttcggttgcatcaaacaagtggttgctcgtgtaaaggccgacttttggccccaacaggacctgactgccgatcgtaattggcgccccatctaacattacacaatcatagttggcataaaagttatcacctagatgaatgttccgtccaaattcaacgcgaaaattaggatttacaaatggcttgcgaccagctgaaccaaccaattgtcgcaataaagtttctttagtctctggatcagcagtcgcattgaccgcgttcgttgtcaacgtcgcttggtcacgtaacgccgttagttctgcatcagtatctcgatacggctgaccagtcgccatgtacgcaaacttctcatctaaatccatcccgcacccctcttttatcgaataaaattcaagtaccacgtgatggcacagattccttgtgctgaacgaatctggccattctttactaggtcaatcactttgctgagcggaacaagttgcgtattcacgtattcgtccgcatcaaagtgtcgttcgccatgttcttgtggatcgatgtgggtcaaaatcaagctgaccgtttcgtccgtgaagccttccgacgaactaatttgcgtcataatttgtggttcatgggcgatgtagcccgtctcctcttgtaattcacgggccgcggccgttagcggatcttcccccgcattaatgaggccagcaggtaaactgatcgtctcggcattgcgaccgacccggtactctgaacctagcacgacttggtcatccgcggtgatggctaaaatcgtgacggcgttcccgtgctgaatcaaatcgcgttttacttctaagccatccggtgtttcaatcgtctgtttgaccaaatcaaaaatcggcccatggtacaccggtgtcgttgagaggaccttaccgggccggccaactttctcaaataaatctgccatacacattcactactccttagtctttctcaaatctggtacgcccgccggcaacatcttacgaatgccacccgcggggtctggcacgtcaccttgatatcgcggtatcagatggagatgacaatgcattacggtttggcccgcagccggttcaacgttaatgccaatattatagccatccggatgattgtgcgcatctaggtacgcttttgcttgggtcaataaggcgagcatcgcattcctggtcgccgtgggcacatcaaaatacgtggcataatgtgctttcggaataatcaacaaatgccccggactcaccggctttttatcgaagaaggccgctgctaggtcattctccaaaatatacggcaacggctgacaaaaaatacaagccataccaaagtccccttcctattttgctaaccaaccaccatcaattggaaccaccgtcccatgaatataatcagcgtgctgactcgctaagaatagcgtcagatctgcaacttcctgcggttgggcccaccgttttgcgggcgtctcactggcaacccatttcgccatcttaccatcgccagcaaaatcagcggcattcatcggggtatcgatagcccccggcgcaatgcagttggcgcgaattccctgagccgcatagtccaagtcaagttgtttcgtataaccaatgatggcgtgtttggctgcggtatacgctgcgccgcctccgccacccaccagtccagcgatcgatgccatattcacgaaaacgccgtgttgtgcggctaacattgcaggtagcaccgcattagtcacgataaactggcttgtcagatccgtcgccaaaatatcttgccacgttttcagatccgttgctaaagttggttgatagccgtctaacttaccggccgtattgcacacgacggttggcttgccgagtacgttaactcctgatttaatcgccgcgacgagcgcattagtgtcggtcacatcagcaatttcatagcgcagggctgacgtcgttactagcgctgatggctgtggctgccgatcaatggcaatcacgtcagccccctgggctaggaaactctggacctgggctaagccaatcccggaggcagctccagtaaccaagacagtctgtccacgatattcatcaaattgcattagtcaaccaactgccagtccgtcgctaaaatatcacaatccgttggtgaccacatactataggcttcatcggccgttttgattaaaaagtacgggttcagcgggtcgccgttaaaagtggttgccgtctgtaattcgacgaacaattcggtcccttcccaaccagtccgaacagcgcgcttaccagcttttaattcaggtaaaatagcttcaaatgtcatcatgatacctccaattattaatacccaaatcgtatcataatcccgcgtggagtgacaggcaaaaattggtaccaacaaattgtctattttactggtacggaccaattatttgtgcgataatgtaagcgaatacagaaactaattattatttggaggaattttaaatgagtaaactcggtgtttccgtttatcccgaacgatcaacctttgaaaaggatgcggcgtacctcgatttagccgcaaaatatggctatcaacgggtattcacttcactgcttgaaatcaaaggggaccaagccgcagtggttgccaactttaaaaaagtgatcacttacgcgaaccaattaggcttgcaagtaatggtcgacgtcaatcctgacctcttcaaacaacttggcgtgtcctatgacgacttgtcattcttccacgacctcggtgcctggggtgtccgcctcgacctaggattcactggtcaagaagaagcccggatgacgcacaacgaattcggcattaagattgaagtcaacatgtctaaagggactcactatgttgacacgattatggattattcacctgaaaaagataacttactaggctcacataacttctacccacaacaatacactggtcttggttatgattattttgttcagacttctgaacaataccgtcagtatggcatcaacaccgccgcgtttgtttcatcaaatgatgcgacttatgggccttggcccatgcaagacgggttatgtacccttgaagatcatcgggggttaccgattgcggcacaagttcaacatttgaaaatgacggggctaatcgacgacgtcttaattggtaacgcctacgcgagtgaagccgaactaaaagcggctgctgaagtgttctttagtccttacccactgctacacgtcgaaaccgttgctgatctatcggcagttgaagaaaaagtactctttgcgcaaccacagacttatcgcggtgatttttcagattacgtcattcgttcttctcagacccgggtcatctacaaagacgaagcctttcctgctcatcacctagatgccattcataccggtgatgttttgatcgataacgatgagtttgggcaatacaaaggtgaattgcagattgcacgccaaaatcttgaaaatactggccgaatcaatgtggttggtcatattaccaagagtgacttaccttgccttaacttgttacaaccgtgggccgactttaaatttgtcgctgccaaatagtactcaatgaatggaggggtcgcattaatgacaactgattaccgtttaactagcgatgctgaccgcgaagctttctaccaactttatcaatacgcgttcaataatcacgatacccccgcgcggcggcgatttttcatggatcgctaccaacatggctggatctacggccgtcacgatcatggtcaactggtcagtgggctatacagtctaccactagcagtcaactttcatggcgtcacctaccggatgaatggtattggcgacgtgatgagtgcgcctgaatatgccggtcagggtggcgcgggacagctgttaacgacggcgctgacagaaatggcagccaaccacgtgacgctgtcctaccttgcccccttcgcgtacggttactatcgtcgttttggctatgaacacgtcttcgaccacgcgcaccaggtcatggccgctccagacctaccacgtgtcaaaccgacggactggtctggtacgatcacccgctatggcaatgacggactggcccaaatcaacgatttttatgcacgacaaccgcaaaatcagcgtggtggtctgattcgaccagcctggtggcaacattacctgactctcaaacatcattggtcggtcgcaatttaccgcaatgcggctgccaatatcgagggctatttgatctatgaacggcaggccactaactttgcgattcaagaatgggtgactagcacgccgaccgctttcgaacgattggctaactttatcactaagcatggcaccacctttgaaacgtttagttatgatagcccaagtgcgaccaacggcttggacctactagccgacccataccgtttaaaagtgactgtccagccgtacatgatggcccgcattgttgatttatatgactttatcaagcgctatccgtttctcacggacatccaaccaattcgcctagcagtcagtgacgctaccctccctgctaatcaaggaatctgttcattgacgcggcacaacgggcaagtaacgctcaatcgggttagcgaccaattaactgggccggctgacattcagttaacgattcagcaattaaccactgcttgctttggcacccagagcttagcccgggcgtaccaacacggattaatcaccggtgatgtgaatgcgatcaaccgacttgacactagtctagttaaagaacgaccagcacttattgactacttctaagtgcttaatttagataagcagcatgactgactcaaagtgggccgccagaataatcattctggcggcccacttttttaaagattcgtatttcccgttcaaacagtttttatcacatatccagtatttttaacaataagattacagccaattcttggggcgtttcttttgcggcaaatagtcattctcaccttagtctattcaaaaaagatgtctgaagatccgactagatctccaaacatctttttactgacattatcctggttaatcaccagcatcgtgcgtaaataaaactaacgaatattaattgattaccaatgtaatattaaccatgtcttgacattaattttcatacaaataacccgcatcccgtaaagctgccttgatggctgttaattgttctggggtctgataagcaaccgtatggctatggacgccatctgttaattctgataataaatggccttgcaatttcttgagccggcccataaacagattaacatcaccaactgagcgaatctctaattcaccccggagccggccatacaatgggtgttcgacttcaacatccttgattatgccccctgcgtgaatgatcaaggccatttcctgcatcgcttcgtttggaaaatgacggcaaactaggacagcagttggctgatccgctttttctaattcatacccttgaagagtagcaacaatggccgttccgtgagccctcaataatgaaatatccccaacaatggtctgacgactaacgttaaactgcttcgctagcgttgttgcacttacggggacctgcgtttgcgataattttgatcgaatttgttcacgccgttctgatcctgtcatgactcacccttcttactctttcaatagaatcattctaccagaaaaccagtagaatagctttcatcaaatactaaattatgataaactaagttcatttaccataggtgtcaagacacctaaatcttaataacgggattgattagcaatgcgcaatttatctttattaaccgacttatacgaactctcaatggcaaatggatttcatcacgacttacctcagaccaacgctaccttcgaccttttttatcgccgggttcctgacaatggtagctttgtcattgcggccggccttcagcaagttgtcgaagctttacaagattttcattttaccaacagtgacctcgactacttccgtcaacttaacctatgggatgaatccttcttagccatgctggcaaattttaagttaacttgccaaattaaggcactaccagaaggaaccccggtctttcctcgtgaaccactattgacaatcactggaccacttgagcaagcgcaattacttgaaacgctcgtcttaaatatcgtcaatcaccaatcactgattgccactaaagctcgtcgactgagttatgctgcggcaggacgtccaattatggaattcggtgcgcgccgtgcgcaaggcccggacagcgcgctttacggcacccgggcagccattattggtggcgccaatagtacttcaaacgttctcgctgcgaagctgtttgatattcccgttgctggtaccatggcccacagttggattgaggccttcccggatgaactaacggcgtttcgcaagtgggccgaacaatatcctgacaatagtgcgctactagtcgatacttatgatgtgcttaactctgggattcctaacgcggtgacggtctttaaggagctacgagcagctgggcatgaacccgtcggtattcgaatcgattcgggggacgtcacgactttatcacaagctgcccggacacaattggacgcggctggctttcccaatgccaaaatcactatttctaacgcattggatgaacacatcattacttcgctgttgcacgaaggcgcaccgatcgataattttggtatcggtgaaaagctcatcactagcgcgtccgcaccggttctaagtggcgtctacaagcttgcggcaactgagagcaatggtcagagcacccccaagatcaaggtcagtgccagtcgcgaaaaactaacgattcctggtgataagcaagtctatcgtctgtacgaaccaggaactcagcgggcctttgctgacttgattgcactagctaccgagacgatcgtcgatgcgaccagcctaaccgtcgtcaacagtgacccactcagcgtcgaccgccaacagcgactcacccattttgaagcccggcccttactcgcgccggtagatttgtccaacaccacgtcaatttcggttacaaccattcaggcaacgacccaggctaaacttgccgagctcccacgaacaacccagcggctcgtcaacccagatctttacccggtctacatgacaaccacactcagccagttacaaactagtttgttgaataaaatgacgatactagcagattaacaaacgaacacgcgtagcaacgactaaagccacttctgtacttagcgttcaaatgaccgctaagtacagaagtggctttagtttatatcaagtaacacttagctcactgaccagtaatttgatcatgttcacccggggtcaatattttggtcatcaccgtaatcaaatacgcttgttcgcgctcaatttcagttcccggcaattccagcattaaccgcgctaggtaaccgaatagctgcgataacaaactttgcagtatcaaatcattcggccaatccacaatcaaatgatccgcttttagttgatttatgacacttcccatctgctcgaccatcttaggcgcaatctggctaagaatctgttcgcgtcgttcggcgtcaaaagctgccatttcaaaaatgacctttaactctttcacgttagctttagcaaatgcaactcggtccgtaaaaattgctgtgacgaatgcctgtagactgggataacgctgccgtaattcatcctctgaaaaatcactcgctaaaattggcacaatgtgcgcggcaattggggctaagatggcatcccgtaaggcagccttagtcttataccgccgatagaccgtcccctccgcaacgccggcccgttgcgcaatatcactagtactagtctggtcaaaacccttttcagcaaacaaatcgagacttgcctggaggatggcccgttgcttaggtgtaatctcttcattctgacttagatcctgttgaaagtaatcccgtatccgtggtcgttccatatcctcacaccttccgataacgtttcatgccaacaatattcaacattgttagtacgaccataaatcctactaatattaacaaattgacaccaatatcgccaagtccagcgccctttgtcacaacagccgtcaacgcattagcaccatagtacaacggcatgatgtgggcaattgcttgcaaccaactggccatgccatcgactggaatcaacccagcaaaaaagatttgtggtacaacgatcagtgggataaattgaatcatttgaaattctgagttagcaaaggtggaaataaagatacccaaggtcaaagccactaacgctaataataagttagtcagaaagaccagccaaatactaccaactaagtgaatcttgaagaccgtaattgcaaagacaacggtcaggatagtctgaatgatggcaaagcccccataaccaattagatagcccataataatttcactccgtcgaattggggttgcaagtagccggcttagggttccagtagtgcgttcattcaaaagtgaaacgccagaaatcaagaacacaaagaaaaagacaaagaaaccgagaaagattggcaaaaagttttcaaagaacgttgaatcactactaccataaatataatgactgctagtggtataggtcgtcgtttgtgattgactatttgttggcgccgcaacattcgctgtagcctgcctcaattgcttttgaatcttagccgcagcagcagtattcccacttgcctgtgcttgggtcaaggccgtctttagcttgctaaccgttgcctgtttttgcgtcgcggtcaacttttgtagtgccacttgttgcgtttgcaacacctttttttgtgctttagtagccgtgaccaacgtctgaatttttaatttgaccagtccgctttgcaaagaagctttgatcaatgacgtattggtcggattactattagaatacgtgatcgttaagttgccatctttttgcgttaaatagccatccaaatcatgctgcttaatcatcgcttttgcctggttactactgtaatggtgaatatcgacatgcttcgtattaatggctttgaccacctgatgatcaacattgtgaacacctaaagtcgccacttgagtcgtgttattttgaaacaaaaaatacatcaacgccataattaagagtggtgccaaaaacatcagcgccaaggtacgcttatcacgtaacatttgcttaaaaactcgtctaacgattgccatcgttcgcatcttgcatccgccccgctttcaaaaagacctgttcgatcgtatctactgcatactgttgtttcagtgccgcgggtgtcccctcagcaagcgcaatcccgtgccgaatcaacatgagataatcacaccgttctgcttcgtccatgacatgcgttgtcacgagcatcgacttaccggtatccttgagcttatttagttcagtccaaatttgttgccgtaattctggatcaattccaacggtcggttcatctaaaatcaataattggggatcctgaatcagggcgattgccaacgacaagcgccgtttcatcccacccgaatagccactgacccgcttgtctaattgggacgtcaagtcaactaatccggctgcataatcaatcatctgtgctaactttatttttggaacactcattaattgcccaaaaaagttaagattttcccgggccgttagtgtctcatacaaagcatcactttgagccatatacccgacttgtgccattaccgccctattgggcatcaccgtatccatgactttaacagtgccactatccacagcttccatccctaaaatactcttgatcaaggtggtcttcccagctcctgatggcccaatcaagccataaatcattccagccggcagtgtcaaatcaatttgattgagcacttgctgatgaccaaagtacttgctgacctgcttggcgatgacataatccgttgccattttaataaccctcttccttaaaatgagtgtctactcactcacttaatggctttagtataatcagtacgtctcggtttgtcaacggcaaaatgagttgtcactcacttttttgtttccggcccatttgtcaccgcattccaaacaaaaatgcgccatctcgttattgagatagcgcgttttaattaaatattagcactgatataagcattagcagttttttaacgattgttaatcttggtcagcaatttttgtcctagctcataatccaactgacgctccgattccggcatcatatcgccgccagttgcccagacgatgtgggtgacgtctttgccagcgagcgctgaaaattgggccataacgggcgcaatcgcggtaaatccagctgcagcagatggttcgaccatcacatcttcggtatcgacgagcttcgtcaaataacggtataaatcatcatcttcaaatgttgctgttgcgagtaataacgttcgcatcaccttgcccgccaatcgtgatggccggctaacggctaacccatcggcggcagtcaatccatctaaaccaatgtcttgaacggcgattttttcattcagcttggtcatcatccccaaggtcacggacggcacgtgggtcggttcacaaaagacggggtaaatgttggctcccatgatcatcttgaggccaaaagcaacgccactaggactgccaccgaccccggctggcagataaacgacgaccggatgctcagcgtccatcttaatgccttgtgcttttaattgatgttgcaaccgtaccccagcaaccgcgtacccgaggaataagtcacgtgacccttcatcatcaacaaagtgtgtatggtcatctttagctgcagcggcgcgggccactggaatcacacttgaaaagtcggtatttagttcctcaacggtgacgccattggcccgcagtttgtccttcttccactgacgagcatcgtgcgacatataaacggtcgtcttgaaaccaaatgttgcggccatgatgcccacactgagtgccaaatttcccgttgacgcaacgatgacgccgtattgtgcaaataactcgtgatactcaggcgttgccaacacactgtaatcatccatatacgttagatccgtgtgagccatggcaacttgttctgcaaacttgagcacttcgtaaatcccaccacgggacttgatcgaacccgaaattggcaactgactatcagcttttaagtaaagctgcccggccaatgactgatggttgatagcctcccatgcgggtttcatctgctcaagtggtaacaatggtgactcaataatcccattcatagctgccgtttctggaaaagcaaccgccaaaaatggtgcgaaacgttcccaacgtgcgaccgcgtcaaaaatatcggcccgcgtcaacggcaggtccgcccgcttcccataatctgggttctgccaaacaattggtcgttttgccatcaattccttaatctgtgggtgttcttcaatcattaccgttgtatccatactttcaggtccttttcatttaattgcatcatattacgtatcgtgagttaaaattatcagttttcgatggccgtctgcatgcgttcagcctattccgaccttccgagactaggtaacatactgaaacgtcaccacgatcagcacaaatgccgataagtcgatataacacgcactgagccaacaagcctcccccaacccgaccctttcaaccgaacctaagttagtggcttttctctgaatctaacgatttttaatcacaactcatgttagataatatgacatcgccttcgtctatcatttaaccatatttgatacttagaaacaatctttaggcactgattaacaataattgttgattagccaatcaaacaagctaataaggcaatcgaaaaacgacgttcaaagttcactcactttgaacgtcgtcttcaattagtggttattaattgactaataatcgtcgttcgaactgcataatcattcagtagtcttctagcacaacgagtttcctacttcaaatcggccccattcgtccgaatcactttttgataccagtagaacgaatccttcttcgagcgctctagtgtcccgttaccttcatcgtccttgtcgacgtagataaagccataacgtttcgacatctgaccggttccggctgagactaggtcgatacaaccccatggcgtatagccaatcaagtcgacgccatcttcggtaacggccttgatcatttcactgatatgagcgcgtaaatagtcaatccggtaaggatcatgaatactgccatcggcttcgactttgtcacgggcacccaatccattttccacaatcatcattggcttgtgataacggtcttgcaaccaattcaacgagtaccgcaaaccttctggatcgattggccagtcccattcactcgtcttcaagtatggattgtcaacggcttcggtcccaacaaagtggtaacttggattgtcatcctgggcagcgaccgtgttggaattatagtaactaaaaccaatataatcaacggtgccttccttcaagacctggcgatcttcagccgtgatatcagggcggaaaccagtctgtttgaagtaagcttccatattatttggataataaccccatgactgtacgtctgcaaaccaataacgccgctgcatggccttttcagcttgcatgatatcttgtggcttagcagttgcaggataaatcggtgtcatgttgatcatattgccaatctggaagtcgggattaatggcatggccaatcttaacggctagcgcactggcaacgacttcataatgagcagcttgatacatcaacgcttcagcgtcaggatcatcgggcttcaacactaaaccagaatccgtcgccatcaggaattggttcgtataagtcgtctgattattaatttcattgaaggtcatccagtacttaaccttgttcttatagcgtttgaagaccgtttcagcgtagtgcacgaaaaagtcaatgactttccgcgaacgccagccaccatattccttaactaagtggtacggcatttcaaagtgggccagcgtaatcactggttcgataccatattgccggcaagtatcgaacatatcatcatagaacttcaaacccgcttcattgggttcttcttcatcaccatttggaaaaatccgcgtccaggcgatcgatgtccgaaaacacttgaagcccatctcagcaaatagcttgatatcttccttatagtgaccataaaagtcgatgccttcatggttcgggtaattcttacccgcaatcacaccatccgtgatttcacgaggaacaccgttggcaccggcagtcatgacatcagccacactgacccctttgccaccagcttgccagccgccttctagttgatgggctgcgaccgccccaccccataagaaatcagatcgtaaaccactcgttgttgccatgcattatcatcctttcactataaatcttcaccatcactcgcaataacttgttggaaccagttaaaggagtctttcttagaacggtcaaaactgccttgaccattatcatcggcgtcaacataaatgaatccataccgtttcgccatttcaccagtacttgctgagaccaaatcaatacagccccacggtgtatagccaatcagatcaacaccatctaatacgaccgcttgttccatcgccaagatgtgatcacggaagtaactgatccggtagtcgtcatgtacactcccgtcggcttccttcttatcgtaagcgccaaagccattttcaacaatgaattgtggtaagtgccaccgatcttgcatccagttcatcgcatagcgcaacccagttggatcaatttgccagccccaatcagacttctcaacgtaggggttctcaacaaagtcatcgggttccttgaaatcgtaatcactgtcaccgtcacgaccctttgtaacaaatgacatgtaataactgaaaccaacgtaatccaccgtaccagcctttaaagttgccaagtcagcagcggtaatatccatatcgaagcccttgcgttcaaagtacttcggtaaccactttggatattcaccgagacagtggacatccccgaaccaataccgtttttgcatggcccgttccgccatcatcacatccgctggtttagctgttagtggatagattggacacatcgcgaccatacagccgatttgaaaatcaggattgattgcgtggcccgcttgcacagctaaggcactcgctactaattcataatgagctgcttgatacatcgcctgttcccaattgtcatccttgctaagttgtaggccggaattttgtaacaatgggtgcgggtcactccaagctgtttggttattgatttcgttgaaggtcatccaatacttgaccttatcctgatagcgcttgaagacagtcttcgcaaaatgaacaaagaagtcgatcatcttacgattgctgaaaccaccataagacttcactaagtggtatggaatttcaaagtgtgacagggtcacaacgggttggatgccatgcgataataaatcatcgaataagtcatcgtaaaacttcaaaccagcttcgttaggctcactctcatcaccattcgggaaaatccgggtccacgcgattgacgtccggaaacacttaaagcccatttcttcaaataatcgatcatcttctggatagcgatgataaaaatcattgccccagtgattaggatagattccaccatctttgacgccatccgtgactttacggggaaccccgttacgtccggctgtcattacatcggcaatgctaactcccttgccatcaacatcccaagcgccttctaattgatgggccgcgaccgcgccaccccacagaaaatctttgggcattttgtatccttttgtcatgaactaattccctccattaatgctgctcaggctatccctgagttacagtctttgttaccttaactaacgaaaagcgtgtaaccgccacgtcaccgttgttaagctgtctgccattataagcgaccacggcatgaatgaaaaaacaagcccagaccaacaccagcaggtatttgcctaggctcaaattaattaactacttcgcctcatcggcagctaaacgccgataaacgtctacaacttcaccagctaagtcgcggaaggtgatggcattcatgatgtgatcttgtgaatgtactaataacaatgacacgtgagtatgttccccttgtgcttccgccgttaacattgaggtttgtgaattgtgtgcttcggttagaaagttatctgcttcctttaacttggcatcagcggtttcaaagtcgccttccttagcagctttaattgcctcgaaagcggaactctttgcattaccaccattaacgatcaaacccataatggtttcgagacttgcttcaacttcttttgtttgttcttctgccatttaccctcatccttttagcatttattcgtgtgcatcacaatcaaaatgccaccggccgcgattgatctaccttgggctggtagcacttacaatttaatgattagtttgcttttgcaattgatgcttcggcttcctttaaaactttttcgccgttcatcatgccgtagtcttgcatgttgataacttcaactggaatatcaacgcgcttttggaaatcacttaacatataacgaacttgtggtccaagcattaaaatgtcaggattcttttcagctaacttcgcatcagcgtcactggcagcggttgcaaaaatatctgcatcaatgccttctgcttccgcagccttttgcatctttgagactaataatgacgttgacatcccagcggcacataccaacataattgttctttcagccataataaacacgctcctagattgttttaaatttatatgttacagcggttgctttaataaaccgctttcattacaattagaattataagtcatgggtacaaatttgacaagccttattaatcagatatctgcaatttatttgatttgtacccacaaattattaaataacaacttaatattcgaaagaagtgaacaccatgtatcgtgacattgcaaccaaactcgttgccgccattcaagacggcatttttaccgtcaaactccccacggaagcccagttaatggaacgttaccaagctagccgcaacaccattcgcaaagcgattgacttggtgtaccagcaggggctcctgcgtcgggttcaaggcagtggctattatattactaatattcagcttcaacataaaacggtagtgaatctgtcagcacgctcactcttcaatagtcatgtccacccacggactttaacttccaagattttgacttttgatacgatccacggcgatagtgccctgagccgcaaactcaacattcccgtcgacgaagaactgtatcgtatcattcgcctccgctattggcacgaccaactgtattgtttggaaaaggcctactacttacgctctgtcgtcccctatctatcgaccgaagctgtcaatacgtcaatttgggacttcatcaacgaagcatacggcatcgggatcgccaacagtgatgactatctttcactcaccaatctcaacaaagaggaagccgaactaatggggttagctcaaggagccacccacttagccttagattcttgcaactattataagaataatggcttactggatttctcccacaccatcttcgtctatcccgaccttgcgttgtattttcatacgacaaatcttgcaaataattaatttatggctaaaaaaaggcgattcactataatttcatcacaatttatgggtatactagtaacagtatccaaatttacgatggaggaattagcgtgtcagcaccccttttttcagtggttgtaccagcttacaaccagcacaaatttatagatagctgcttgactagtctacaacgccaaaccttgacagactttgaagtctttgtggttgatgattgctcgactgatgacactggtgaacagattgccgcgttaatcaaaggcgacgaccggttccacgtgatcactcacgcccataaccggggcgtctccgcagctcgtaactccggtatggctgctgctaagggtaaatacctttgctttgtcgatggcgacgattgggtcgaaccagacttcctggcaaccttcctagccgcctaccaagcagcacctgatacccagctcgttgtatgcggccactacggttacttagcagttccgagtcccgccaaaacatacagccaaaaagatttgattgctaacatcaactttgggacggtcggtggtttttcgtggaataaagcattcattcgcagcattattaccacacaccacctcaagttcaacgaagatatcgacttccttgaagatcagttgtttgcctttcgttacgcgaactacgtacagtcctccgaatacgtaccggaccgaacttaccattatcgttggcgttttcgaagcaacctcgcgcacatcgggattccgttcttcaccgctcgtcgcaagatgatgaagattctcaagcaggaaaacaagcaagttttgaacgaagattggaataatcagtagcaacgttacgttgccatcgcccctaaaggtcggtagctgaaatagctatcaccctttaggggattttttgatacctagcataatcggctacgatgaccagaagatgcgcaattattcgaggctagtagccatccactcgcagtctggaatgcgcttccaccgccaattaaaccgaccgtggcgcgaaacaagctagctgctcaaactctttttgatatcagcgacaaaataaagtggcaattaacaattaaagacttgttgaataaccggtaacgtcttacaattggactatgttaattaatttgatgggagggttagcgatggctacgattcacttatacttagtccgtcatggacaaactaagctcaacgcagctggccggctgcaaggcatctatgactcagagctcacacataccggtgtccgctccgcccaacggttagcccgcatgctggcagacgttcatttcgacgccgcttacgtcagtgacttgggtcgagcccaacaaacgagtcgcatcatcaccgcactccatcctgaaataaaaaagccgacggttgacgtcggcttacgcgaatttaattttggtgggcttgagggtaccagaaacatgtggatcgtcaagcaagtcaaaaaacaattgggcatcggaacgtttgttaagttgatgttgagtcgagagcgcttcgccacgctactgtgggtctttaattccctcgaccagactcgtggcgccgagactttagtcggtgtcacggatcgaatcagtagcgcgctgcgccgaatctgtttatacgaatctcaaaacagtcaacatgacaagaacattctcatcgtttctcacggactggtcctcagtgcattcctataccaaatcagcccccgtgagctgcccacccgactcctgaaaaatacaagtgtgagtcgcgttgattatcaagatcgacaatttaagttgattgacattaatattacccctaagaagcgggtctagtcgtctcgacactaagcgcctgggtggtacaacttggaaattgcaagcgggcctggataccaaaaaaggctttgattttgcgttgcaattcttgcccagtcgcatgaactgcgtcctcactggcctccagatcaccaatcacaattaagatgcgactgcttttactgtcgacattaggcttgattggggtaacagcatccgctgaaaggctggccccctgtgccgttaatcgaagctgaacctgctcagtacctagcgcgttcatgtcccacgcattgatttgcactgggtgacgtgcgtgaatcacttggatcaagtccgccaaggcactctgcggctgagcaacggccagatcttgcatggtcagttgcttttcaattgctggattcaactcgcggttatcaagattgctcattgacaaaatcgctagcggaatttccgcggtagtcgtcggtaaaatttcaattttcaacagttatcacttcctaaaaacacttcaatactaagtgtgccaaatttgacgtaaaagtcaatcaccaccacttaagtcatagcgaaattttaataataacacaaaagcgattctcaaacacgtgagaatcgcttttttacggtcttattgtcctcgtcgatatacaaatacgcttgtaagctgaccttacttagtcgttgacaagggggtgagccgcaaagtatttttctaagaaaagcgccaaaccgtcattataattcatatcagtcacatagttcgcgactttcttaacttgtggcaaggcgttgcccattgccaccgataagtcagcttcagccatcatcccaacgtcattcatgccatctccaaagacaaacgtgtgggcagcatcaacatgttgctcatgttgaatttgtttgaccgccgtccccttatccgtatttagcgggatcatctcaatattattcggattcgatgatgacagccgcagtaatttgctattcgttagtttttcacgggcagaatccaaccgtgacatatcttcacgactgagaatcacgccgttcgtaatctggtcctcaatcgtggccaattgcgtaaagctcttcacttcttcatagccgattgagacttcatccgcatcaaagttggccgcattccgtgccacgaaccgtggaatctgttccgtataataggccatgtccggcgtgaacagcatcattggcaagttatcacgacgtgcaatcagataggcaagctcaactgcagcccccccgagtttggttagctcgcggccctgggcaccatcgaacaccgccccgttagacgttaccaagcgcacgtcagcgtttactttgtcccgaacgatcttcgccagctcgtacatgcgccccgtagcgatgtaaaataacacgtcctgcttctgcaaccgttcaatcgtcgcgcgagttcgctccgagacatattgatgatccgttaataatgttccgtcaatgtccataaagactagatattttggcatagttgaactcctcctacgtatttacctacgtgctgtgctagcactctgattcttactgtcactcagccagattgcgctgctgggcctacaaacagtccgccccactcctgcaatcgctggtaaccacacagcttagcgcgagtcactgatacgaacacccgctatttagccgggacttgaaggcgctttaattccaaaaagactgccccgcccagcattttgccagcaatcataattagcactaggcttatttacactttcaattgtacgctattccaccctataatggaaatcgctttcaaaatcaggggcgttaacgcattttgaccagaccaaactgaacaatcttaagtttagtggtcgttttagccctttattttccgtaatcagctttacataccaaaggattcaaacgtgcggcttgacattcagtcactaggtcgctaaattagagaacaattaataaatgatgaaaaagcattgagcagttcagtagttgccggccgttagccttagcgagtctgagatggtgtgagcagacctaacccggtatcacgaacatcggctgtgagtgttcgggtgaaactaagtaacccagactggttaacacccattaacgtgtggcacacctgttatgatgtgcttaaggtcagtaatgtgagtcactgacgaataccggtggtaacccgcgctcgcgtccggcagacaaatcgtctgccggacgctttattttcatttattaataaatcactttaaaggatggtcatacatatgcattttacagtactcggcgcaggcgccatgggattacgttacggtgtgttattacaagaagcaggcaatcaagttgattttgtggacacgtggcaaaccaacgttgatcagattcatcgtcaaggtggcgtctacgtgtcacgcgatcaccagaaccgccacttagttcccgtcaaagtctcgacgcccgaagattatcacgacgatccggatgtgtgggtcgtctttaccaaacagatgcaacttgctgattttctgacgcggaccgcccacgctttcaacgaccaccagtacgtgctcacttgcatgaatgggatgggtcacgttgaaaagctcttacactactttaaacctgaaaaattattagctgggaccgcgctagtcgctacggtcttgaatgggcctggcgatgtcgatttcattggagctcgtggcgccggcaccatgaatcttgctaattatacggaacagccggacgacatgacccaccgaatcgtgacagaattagataaatgccaattccaccccaatttaacgacgaatttccgtggtaccttactggccaaagtcgtcttcaactcggtggtcaacaccctctgtaccctcttcgaaattacgatgggtgaatttgccgcctatccaggggccgatgagctgagccggcaattgatcgatgaggcctatgatgtttgtgaacgcgatggggtcaccatgttgaatacccgcgcggaagaactcgcctccgtcaactacgtcagcaaagtggcgaatccgctccattacccatcgatgtatcaggatatgtcgcataaccgaccgactgaagtcgattatatcaatggctacctcgtcaagctcggccaaaaataccattatcaagcaaaaacgcacgcgttcttgactcacctggttcacttagccgaaacgacccgccaagccagcaccgcaactgaacacgatactgaacaaaatgttcaggacgcgactgaacaagccagtcaacaagcaagcgcgtaaccgattccccttttctcagcaaaatcatgtacaatggaagttaagttgattttactgagggaggcgattcactgtgcaagtcagtcgggaattcaaaggcatctttcttgccagtatcagtgcgaccttctgggggatttccggagccgtcgcacaaacactttttgatacgaccgacattaattccatctggttaacgggaattcgcatgttgggagctggcattgcgctactactagtcagcttgctgacccacgttgatctgtggtcgatctggcgtcacccccgcgatctgctacaaatcatcgcctacacactattgggcctaatgccggtccagttcacttattttctagctgttgaagctagtaacgcagcaactggaacgatcctacaattcatgggccccgtgttcattgcgttgtggatgttagtcgctcaccggcaattgccgacccgcgcggaaggcctcgccattatttgtgcgctactaggttcattcttgctcgtgactcacggcaatcctcagactctagtcatctccgtctgggcgctgatctgggggctcttatcaggggtctcgtccgctacgaataccttgttgccgaccaagttactcactaagtatgatccaatgaccgtcaacacctggtcaatgttattgggtggtatcttgttcaacatcgttcagccagtctggtcaatccatattccactgacggtgctgaatatcagcaagttgaccttcgttgtgttgttcggaacattgttagctttcctgtttttcttgcaaagtttgcaatatatccggccaaccgtcgtcagcctgctagatgctttcgaaccgttatccgcaactatcattgcggtggtgctactcggtgtcagctttggttggctcgacattctgggcagtgtcctgattattagtaccgtctttattttggcgatcgggcagggtccgaatgatcgcacggcgaagaatttcaaacaaccatgaagccagtaaaagccggttgtgactaagctttagtcacaaccggcttttactttgctgctatcgctgaatgcagtcaattaataaccacgattcagatccacttgattacgtaccagtgtaccatctttgacaaactgggcgaagttcgccgcaaagattggaaaaacggtggcccgaaaatgagcgatttgacctgaaatatgtggcgtaattagcacatcatctcgttgccacaacgggtgatctgccggtaagggctctggttcagtgacatccaatgctgccatactgagttggtgttgatccagtgcggtcattaacgccgccgtatcgaccgcgggcccccgcccaatattaatcaacatcggttgctgtttggtctgctgaaataactcagtactaaacaaatgatgcgttgttggcgttaatggcaacgcgttgacaataaagttagccgttgccaacacgtcggccgtcgcggtaaatgccacgttttcatgaaaatgatcagcggggtgaccggtcgtattgaccccaatcacgtgcatgcctaacgcactagccttcgccgctaacgattgcccaatttggcccgtgccatagatcaacaactgttacccggtcaaggttgatgtcgtcattggcaacgcccactgccgcgctccgtgctgattcaaccaggccgcatgatacccccggactacgcttaacatcgcggctaagaccgattcactgattgcatcggcgtgaataccactggtgttcgcaaccactaccccggccgcttgcaatgcctttaatggcaaataatcgacgccggctgagatgacctgcacaaactttaactggttggttggccgcgctaggatcgtctttaataacggatggttcccgtacatgacttcaatttggtcataatcggccgccgtgactgccgccgcatccttgaacgtccagtctggataagcggtttgtaactgttgcagctgttcaggtttggttgcttgggccatcaataccattggcataacttattaccccatctctaatttcttgatcaatactttcatcataccactatcattcggttgaaccgtaatgattcacaatcgaatattagtttagattcacgctgtagattatgcaaaccactttagcctagcgtttggtctaatcatcaatatttgccattgtcgttgacagccaagtcaaaagtgtcaacaaaaggcgatgttcgaaagtcacacttccgagcatcgccagttgataatcagcctaatttgatttaatttctgatcaattacttaataaccgcaaagccaccgttccagccgatttgttcactggctgctagtgtcatttgcatgaagcccatcgcttcgagctcacgagcgcgcttcaacttacccgcatccttcacttctaacggacttttagctaaggcttgagtgaagcgttgcttagcactgtcatcatcaccagcaactaaaacagtcgttggttccttaccattgacctgtccactctgaagtgtcgctgcaaaagtcgtattgaaggctttgagtacctgactatctggtagttgctgctgtaattcttgagcggccgaactatcagctggaacaaccaattcgtcccacgtatcaaaattcaaggggttcgtgatatcaacgacgattttacccttcaactgagccgcgtactgtttggccagcgcagctaaagcgggataaggtaccgccataatcacgatttcaccgaacgtcgtagcttggtccttggaaccataataagtgacctcgtgcccagcgacctcaaaattatgaccaatcgcttgccccatgttgcccttaccaaaaattgtgatttccatctcaaaacacgcctctttcactttataattaattttatatttacattctaacactgatgtcccatttacatcactcaccctagatagtggtactccctggattgatgacaatccgtggaattactggctcaccccaatatggatgttcgcgtgcctgccactcttctcagattgtggggactagtaaatcagtcattaacggccaaaaaccgaccaacttaattataaactaattaagccggccggtttttataatttcagacaatcatcaatgctactggtctattacccagcaaaattaattattgctcgttgtcgtactatagccatccgtagaagaagctgtaccaccggtcgtcgttgaagacgtctcaccataattcgtcgttgagctactatcggtgttggcactataactgtagctaggcgtgctcgagcttgaagttgctgaacttgtgtccgtatcgttgctataactgtacgttgaagacgaactactatcgtcactactttcactataggtcgaatatgatgaactcgacgatgattctggttcgctatagctatacgagctcgaacttgagatcgaagacgacgcgttattcgcttttgccaacttcttgcgatccgtaatcagcttctggtaatcattggccgctaactgcgacttgttacgataagctttcagattagcaagtactttatcgaccgtcgttgacggggtagaagccttaagcttatttttcttgttatacagcttttggaaagcagcgtcatagctgacgactttcttaaccgttttacccgttgtcgtgaacaacttgtcgtacttcttcgcaaagtacggcttgctactggttaaaccagcggtcgtcaaccgttgttggcccttggtgatggtgtccatggtcacatcggtcttgagtagccccttggcgttgcgtaaatcttgataactagtccggaccgtcagcatcttagcagccgtatcatgctgtttctgcaaacgagtcttttcactggaatccttcatattatcaatattgttttgcaactcagtcaaagtcgaacttgaggcgctcgcacgcaagtcccgttgcgctgacgacgtataaacttggtccacgattttttccgcgttagttcgagccgcagcttgagtggcttgcccatggttccacatgaagaaggccccacccgcagcaacaaccaaaattgcgacaccagtcaacattaacttccagttgtagcgccgagatggctttttaagatgcggattcttttcatccgtttctaattcggaaaagtcgcggtcgtcatcgggctggtcatcatgtggtacccgccgttcttcgtggcgagcgacccgtgacatgcttgccttattaggttgcttaccaccatttggttgctgatcaccatacaactcttcacgtgatagtggtaattcaggttgcgtgtcatcatccgctcgttccgttcctttgaccgcaatccggggctgctgtttacgggcaaccggcggaatgtggtcagctgggatgcgcctttcgaccttcggctgcttcgcggcagtcgcttgcgagtccttagcggtcgtggcggtggactttgcgttcgtagcgctgctggccgccgactttggcgctgctgactttggtgctgccgactttggcgctgacgattgggctaccgcagatgcggcggctgcagcactcgatgttgacgtactagattgttgaccgtgcgacttggcctgactggcggcttcctgactggcacgccgagccatccgcgtcatcggaacttccgacgttgccgccgactgattagccttggtacttgctgctgttttagccgcacgcttctggtcagacactgcggtgctggttgcttgtgacgctttcttagcggcccgcgctggtgccgattgcgccgcactagctgtcgtcgaagctgcgtgcctggaacgctggtcacttactgcctgtgatgaggctgcgctggccgtctttgacaccgcctgacttgctgctgaagtcggttgagtcgctgctgattttttagttgtatgagcggatgccgccttggacgacgactgagagccagccgattctttaggcttaactgcactagtcgccccgtgcttgacgggggtcgccgattgttttacagcctggctgccggcttcggactggtgcgcttttttagccaccttttccggttcaattactgcgtcaacgggttgcttttcagcaccactatttgccgtcgagcgtggaatattgactgttgattttgcttcggcttcgtccgcctttgatgcggccgagtctttcagatcataagccaaagggatctgttcattatcttgttcagtactatcatcgtcgggaattggctcagtaatcgaattccaaagccgtctacccaaaccttcttttttattttttctagacaaaaccaacgctcctcgccaatttataatttacattagattcctggttaagcgccgaccaaaaattgtgaccaatttcggtaaaataaccattaatagttaaattatagcatggaatcgtccgctgagaaaccactggtcaagcggatttgtgaataactgcccaataccttaaattaaggttaaaactctgctataatcagcttatcaagatatttgaaagcgaggagttcatatggccactgcgaaagttatttttgctaccattactggtaacaacgaagacgttgccgatattattactgaaaaattcgaaaaacttggggtcgatgttgccaaagaagaaatctcgcaagccgacgcaaccgaattcaacaatgttgatatttgtgttgtcgtcccttacacctacgatgagggcgccctccctgaagaggggctcgacttctacgaggacttacaagatttggacttgaccggtaagatttatggttgcgccggttccggcgataccttctacgatgatgattactgccgtgccgtcaccgattttagtaacgcactgaagaaggctggtgctactcaaggtgccaaggatgtgttcgttaaccttgcaccagaagccgacgatgtgaaagccctggatgcatttactgaacaactcgttgctaaagttcagtaacctgatgactgagtgaacaacaaaggaacgcttcaagaattcataattcttgaagcgttcctttgtttggcgactatcagcacgtcatcatgacgctgatagcgaaaatcacgatcaccgtgattacttttattcagtccttacgatttcaaacacgctgtttactgacgtttcatacgccgaaatccgagccaactgccgaacatggtcaagcctaatagcactgttcccagcacatttgcacggcttggtgcttcgccagtttgtggtaaagtcgctgtgccaagcttggccgttgcgggctgaacagctgctgaaactggttcagttggccgcgacttttgatgatgatcagcaacgcttgattgcgcatgttgcgaactaaccgtgctgggcgtctggctccgatgcggccatgcagtgacttctgacttagccccattagccgtcccttgcatgccagaattacggttcgcatcctttccatgattagtaccaactgcgtgtgttacttcatcaataaccgtatttacatcaacgtcagccgtatcaccctccacctggtcagcatcattcgtgggtagcgctgcttgatcatcaccagtgctatttccggtcgagccggcgttcacatcatcatcagtgtcgctagtatctggttgttcagtgttcgcgccaccatcagtatcgtccacacccggttgttcagtattcgtatcgccagcgttcgccgcaacgaccgtgactgttgccacgcgggtgaacacttggcccctcgcatccgtatactgataagtcacttggtaaacaccagcttgatcagtagcgaccgtgccagttacgactaggtcagcaatcgacaattcatcgccgttaacatccgtagctaagattaaattatcgcttggttgccacgactcaccgacagtcatcgttgaatcttgaatctgtaaatcgctttgggattccgcttgttcgtcggcctcctcgataaccaccgttactgtcatcgttgccgtcactaactgaccagtcttgtcagtaaattgatacgtcaactgatagtccccggctgtagtccaatctggcgttccaacgacctcaatagccgaccagtctaacgtttgaccgtcactatcagtagcattttgaaaattgctttggggctgccacgtactggacccctgtccatccgtatggaccgttacatgattttgatgtaaattcaaactggcttggttttccttaacagttacagtaatcgtctgcgtctgactaccatacgtgtaagtaatctggtaatcacccgggaccatggtgttcacttcacctgtcaccgtcacatcgttaaagtcgatggcgtgaccgtcttgatccgtcgccccgtcaaaaccgtcctgcgcatgccaagtcccaccagcgtgtaattctgtatcatggacagtcagacttgtctgatcagctttcacgatcaccaaagcagtgaccgtcttacctgcatacttgaaagtgacccggtaagtccccggccggctcgtatttacccggtcaccggataactttacagcccggggattagtggcatagagggcctgaacatcgactttttgaccaaattggtcggttaagcccccaatactgtccgtccagttccaattttcgccaacttgtagggtaacgtcgccagcatcgataactgcttggtttgcttcccagacaaaagtctccaaggtggctccctgctgcgtatagagcgccatcagttctttagcactcaaagtttgcgctggattattaatattcacccaacggccgctgtactgctcagataatcgagcctccattagtccgactgataggccatcatcaaacttagaaaaattaattttggggcctaaagtaatctttctcaggctagtacacccgctaaacatccccaaaatctcctgggcgctagacatatctaaaccagataaatctagttcagctaatttagggctcaaaaagaacatcaggcggaaatccacaaccttactcgtattaaaattcacacccagattaatattagtaatattatgcataacgccaaacataccacccattgctagaacattattggtgacaaaatttgaaacgtctagactatcaaatccagtaccacaaaacatattagtcatatctttgacctttgcagtatcaaagcactctaaccccttaacttgttttaagctacgtgcatacataaacatattcgccatgtccgttacgttactagtatcccagccacttagatccaatgtcgtcaaagtagaaaacaaccgcatgtctaccataaaagcgccattcatatacttgacattatgcgtcttccaactactcaagttcaatgactttaaacttagattattataaaacgtatattctaaccaaatcgtattagcagtatcaatcttctccaatccttcatagtgcttgacattgataagattggcaaatgttccacctaaattagttgagttaatattatctgtaataacgaccttagttacttgatcgtaccaagaatactgacgccaaaagtcgattcccatatgagtagttaaatcgccaccaccaaagaaaagcaccccggcattctgatcaaaccaccaatcaacaccaatattaccagataattcagtctgtaatttttctgtttctagatgatctttttcccgtggcaatgcgtgacggtcatctaataaagccattgtttctgtcaaattggacgctttatgattttcgctagtctctgcaggcaggattttatttgcgtcccactcctctatcttttcgtctcgtctaggtccgttattttcagttgaagggtcactactcgttatatcttcaacacgattctctgacaattcatcatcattttcagatacacttgggattaattgattatcagatgtattctgaaccgattgtgtagtagcgtcgggatactcacctaagtctagttgatcttgtgcctgattcagcacactttcaccttcctgaacatctgaaattggcatatttgtctctgccatcacttcaactgaattagtacttggcgcttcttctaacatacttgaattctcactgcaagatgctccggtatccgatttcgtatttaaagtttcggcacgtgacattgaaaattcatcttctagcgtactttcaatacttaaggtcggttgttgctcaatagaactatctgcttgcgcgctaaatagacttatactcagtacaatagctgtggtactcgctacaacccacatttttccacttttatacattttataccgtttcttcgcttgttccattaattcctcactcctctattaattaaccttgacgacgtttaatcccgacgatgctggctaaaccagtcaccattaacatcatgagtcccagcagcccgaagcgattaacttgttcgccagtttgcggtaactcatcagctactgacgtgggatggctgactggagccatagccacttcgggtttagctgcatcacccacaatataccgtttgccatcaattctgcgctcattgcgttcactagtgttcagtttcaagtcatcactaaacaccgtggtcacttgcttctctaaaccagcgttaaagtctggtcgcgccacgacgtctgcttgttcagtttgattgctaggacgagcgtttgcgtctgttaaaccactgttagaatcactagtgtcagggtgttcagtagttcctggttgttctgacgcttcagaagctcccggcagttcgggcgtctctggggccgctggagattcaggttgttcaggtatttcgggctctgccggtgtcgccggggattcaggttctgctggtgttcctggttcttccggtagttccggtagttccggttcagcaggttctcccggtaacggcgtttcaccattgccagtacttgcgactaccgtaaccgttgccgtttgagtccactgcaggccatcggcgttcgtatattgatacgtgatttcataagtaccgggttgcgtcgtgtcaacgttaccaatcacaactaagtccgccaatgttaacggatgtcccgtcgcatcactggcacttacgaagttgtctgtcgcctgccagtggtcaccaactgtcaccgttgtgtcttgaacaaccagttctgtcaggtcttcaacgtcagcctcttgttcagtcaccgttacgatcgttgtcgccgtgactaactgtccggtcaagtcagtgaactgataaacgacctcatacgttcctggccgcgttaagtctggttcgccaagtaccgtcacgttctgccattccactgaacgcccatccgcatccgttgcacttgcaaaattatcccgtgggcgccagacagcgcttcccgttgcgagatcgatttcaaccgtaacttcttggttatgcaagtttagttgactttgattagccacaaccgtgacaaccacggatgtttgccgccccgcataagttagtgtcacgtgatacgaccctggccggctggtgtcaacaggctcgccgctaactgtcaccgcttggggatctgtactgaacaagactccaggatccaccaactgcccattttgatcaactagttgcgcaacattttgtgtccagtcccactcttgatccacgaagagcgtgctgtctttaccggtaatcgcagccgcagagacggtttcccagacaaacgtcgccgtgtcagcgtggtttcccgaatattgcgccaggagttcagcactcgtgaacgtttgcgagctatcagctacgttgacccatttgccggtgtatttgctattcttaggcacttccggtaaaccaactaagggttgcgtgccgtgttgactaaaatccagtcccggaccaagtgtcaacgtttgcaaacttgtcaaaccagctagcatttgccagttttgttcaacattctgcatattgaaatgggacaagtcgagcacctttagtttgacatcatcattaaacaaactattgatttgagtgactttagcgacagtaaactgcgtaccgaattcgatacgctccaaatcggacatctgcgcaaaggcaccatcgatttcaaccaggcttgctgaatcaaagctcgtcagattcaagtgacggacgccggtacgcgcaaacatgttggccatcgtcgtcacactgcgcgtatcccagtcagtcaaaccgtcaatagttcgaagttggccgttgaactggaacatattttgcatgttggtgacattatgagtatcccagccactgagattgaggtatttaagttcagtacccatgaagttccccataaacatgttcaccatcgtggtcacgttaccgacttgccaagcactcaagtccagccgctctagcgaggtattttctttgaattgcgactgcatgttggtcacagcactggtgtcgatcttttctagcccttcgtaacgcgtcacactgtcaagattcgcaaacagactgttcatgttggtaccggctacaattttatcggcaatcacgatacacttgatcagcggcgcccacgacttacgacgccaaggattatccccataactgttatttaacgtccctccgttcaaggttagtgtgcccgtactggcatcaaagtgccaatcaacgccgaagttaccagacatttcatcctcatccaccctagttgcggccgtcatccaggtgcgagtgccagcttgcggggcatctgcgctaaggtcatcgcccagctgatggtgctcagcgttgatactttgcctgtcagcagctggttcgcgcgctggtatattagcagtccccacctgtgcttgttcagctgcttcaggactttgttcactaacggctgcttctgcggcattactgaacagatcctcagtccgaggtgcttcatgattggcggcagacgacacagtttggtcgcgcccgttcactgctggcatcgactcagcggctatttcactatctgatgcgtcaggaaccttgttcagcgcagccgctgatgcgtcagattgcggctcgtcattagtcgctggctgcccatcgattaccgtctgatcagtaatcgaagcgttctcatcattagcctcagcaacgttatccgtattgaaaacggaactcaccggtacttgattgccgctaccttggtcatgaactaacacgtcactggtcactacgacactcgtttcgctagtcgacgcggatgaaccagcatccgcacgtgcggttaacagttgcgtattcaacaataatagtgaggcgcttgcaaataaccacagcttaccacatttatacattttataacgttttacatctgattcacggcaattcatcataattccccatttcctcaaaaaataacctgactgacctaacgattaatctcattaaataaagtgtttttactatatttgattatcgtgtttaactagtacatcatttacggtttttaaatataccatggtatcctcagaatgctcaactgattatcacaattctaattaacccgttatcattatgattaatccgcttatttatcgcaaaaatataattatcagctcgatatttaagtaatcgctttcactcagatgattcgtcagtcttggccagcctgacactttgccaccaacatccgttcaccatagcgacagttgcatcgtgcaccggtcaattgttaccgtaatgactgaccgtgtctaacagtaatgcttgagcatcaaaaaggccttgaacagtaatactgtccaagaccttatttacccattcaaattgcgcgttttccgaattcgattgcggaatgcgacccgcacgatcgttagttcgtcggcgcagtaattgcaccgacgcctgcgtcacttggatcgccgttttaccacgatttgtcgaatcgcattatagacaagctcgacaatgacaaacagcaccgtgatacccacaatatcaattacatacgaactgaatcgatagccgatcttaccgatccataaatcatatggtccttggatcagtaagaaatagatgactaacgtttcaaaaatcgttcgggtatgtcgccaaaacgatcgccattgcattgctttcacgctccttcaattggcgctaacatctgtaacgcctgtttgacctgactcacggctagttggctctggtcaccgacccggccaacatgcccaaaggcgatggctgaaccagtcaaatggctacaaacactgttataccgaccaaacttgcccgtcgccgttgccacgattggcacagctaattgttgctgtgcctgttcagtcgccgccatcaatgccaacaccgtctgcgcatcgtgactggccactgtcacccgcacgacatcagcaccagttgctgctaattcgcgataagtcgccaacaaatcgccagtcgttgccgtcgtgacggtctgactcgcaattaaccgaattcgattggtacgcatctgcttggtcaacgtcatgaaatctggctgattaaccatagctaagtcaatatccaccccggcgacacttcgattattaaccaatgtttgataagtttgataatattcgggcgcttcgggcgcttcattcgccatactgaacatggcaatcaacggaatggtccccagaacttgttgtaattgtgccgccgtattgacgagttccgcgcggttatccaattcttgatagggatttaatcgccaaataacaatttgcgctaccgaggttaaaatctggcccgctttacgcaacaggtcctcccgtgttgcccccgccaaaacaacgccaattttaggctttcctgtcgctaacgttaactccccaaccgtaacttctttcaagaccattcctgctttcatttttcattcgaccgattcgcgtccgtcgccgttaaattttgtctcctcttaacaatagcaaattttcgccattttgacacccaaaattcattttttagtctaaaatttaaagcgcttttaatattaacttgttaatactggtatcgttttcagtttggccttacaattaagcatactttatcacaaaggagttcaacatggaaaacgaaaagcagcttcgctggtccaacattgctttaattgcattcgtggcggtctggggtctgggtaacgttgtcaataactttgcgttgcaaggactctcagtcgtcacttcttggatcttgatcatgattatttattttatcccctacaccttgatcgtaggtcaactgggatcgacctttaaggatgctgaggggggcgtctcgtcctggattcgggcaacgagtactaagcgcctagcctactatgccgcttggacttactggatcgtgcacatcccgtacttagcacaaaaacctcagggtatcctgattgcgttcagctggctgttccgcggtaatgggaactttgtcaatacgacgcctgcgttagtcgttcaagccatttgtttagtgctattcttattgttcctctggattgcttcattggggctaacgacactgaaacgcatcgggagtgttgccggtacggggatgttcatcatgtcgatcttattcatcattctagccgtatcagcgccatttatgaccaaagcaaccgttcagacaccgaacatgttttcaattaagtcctacttacctaagttcgactttacctactttacgaccgtttcaatgctcgtctttgcggtcgggggttctgaaaaaatctctccgtacgttaataagacgaagaatccgggacgtgagtttccattgggaatgttagtgctcgccggaatggtcgccatctgtgcgctgctgggttcattcgccatggggattctgtttaattccaaacacatcccggctgatttgatggccaatggtgcttactacgcatttcaacgactcggtgctttctaccacgtaggcaacctgttcttgatcctgtacgcgattgccaacgtcctcgcccagatttcggccctggcgttctcaatcgacgcgccattgaagattttgcttggtgacgctgaccctgaatttattccaaaaaaattaagtaaaatgaacaagaaagatgtgcccgtcaatggctacatcttaactggggttctggtcagcattctcattatcattcctgcattaggaataggaaacatgaacgaactctttaattggttactgaacttgaattcagtcgtaatgccaatgcgctacctgtgggtcttcttagcttacatgttactcaacaagcacttaaaggaatttaagagtgattacaagttcctgaaaaatccggtcgctggtcgattagttggtgcctggtgcttcctgtttaccgcatttgcttgcatcctcggcatggttcctaagacttcctacgccagcaatcctagcagttggctcttccaactgacgctaaacattttgacgccaatcatctttgtggccttagggatgattttgccaatgatcgcgtgtcgtcatcgcgctaaaaccgcttagtacgccgcaaatttaagtgttcacatcacgattctacgcctgcgaacgcaccgcctttcgacaaggttaatcgatgagtcattcgccaccgctgacagcgcataaagccgtcagcggtgtttttacgttacctgccatgcaagtaattcatgcccgatttcggatgctaatttgtagctcacaatcttacacttttcttgcgtttagcggtatgatgcttagtgaatatagtcaatcaaaatttaccaagccgtcgcccttcaaggaggttcttatttatggctaccgtcgacgctctcgacatgtttctgaccgattacgctaatatctctcgctacctgaactctcgtttgaattcattattgaccacgcaacatctaacctttgacgctttttttatcatgcacgaaatcggtcaaagtccccgaccgctgttattaatggaacttgcacatcggcaccacgtttcccgcagcgcgatttcacgccaaattagtatgctcttaagcaatcaatacattacgcaacaggcgaatgctgctgatcgccgccaaaaaggactttccttaacggctaccggccgtcatctagatcaacaactaatgaccaccatgcacaaaactgttcatcagtggacaatagcactggggacacaacgagtgaaggctctgttagacattttcaacgactttaatgagcaaattattgataacgaggttcctgccggccactagtcaatggcagcactcggtccaatcactgactttgtagcaccgttttctcggtatcatctcgatgttacgctcgagcctattcgaagtactgctttgaatggcgttaaacaaaccaccgcatcaaaaaagcgacgacatgttacgctagcatgctagcgtccatgtcgccgttaattttagttataatcaaaatggtggtgcctctcggacagctgacagggccgcccgtcacacgctagtcatcagcgtgcacatcaaaggcatgcaacaactgttctgagacccccggtgcatcggggtcatgttgacctttacccgtatctaaagctcgtaacttgtccatctcagtgggtgttagttcaaaatcaaagatgtcacgattgctcttgattcgcgcagtgtgtaccgattttggaaagacgattacgccttcctgatgttcaaatctgaggatgatttggccagcatctttatgatacttagtggctaactgctgaatgactggttcttcaagcagttcttgattgccttggcctaaaggtgcccaggcctctaatttgacgtcttgtgccgcaagtaattggcgcaacggttgctgctgaaagtatgggttgaattcaacctgatcgaccgccgggaccgtttcaaactgaggtacgaattgttgccataacttgggtgtcatgttggaaacaccgatcaacttcaatttgccggccttttgcgcatcttccattgcttgccatgcccccggaacatcgccataaggttgatgaattaagtacaagtcaatatagtctaggcccaatttagttaacgaacgatcgatggcgcgactggctgcgtcaaaaccatagtcttgaagccaaagtttactcgttacccagatttcgtctcgaggaatcccactatccttgattgcccgaccaacttcgtcttcgttaaaataggcgacggccgtatcgatgtgtcgataaccgattgccaaggcttctttgactgcttgataagtagacccgtcatctggaatttggaaagtgccaaacccaatggctggaatcgcgcggccatcatttagcgtaatcgttggtgtttttgtcattaataaccactcctcgtatgatataaattattcaaattaatctctgatactattcctgctattactatttattggccctgcgtgataatctctaattgtcgctagctttggtcaattggtatcagttgacgtttcttaacttattcgtgtaattggcgtaaactagcgccaaaaatctgttcgatggtcacgggatcgcggtgatcaaagaattgactgacgccctgattaagttcagccatcgctgccatttcagccgctgttaattcaaaatcaaagacatcaatattttctgccatccgctctggatgcactgattttggaattaccgtaataccgcgttgcaacaaccaacgcaagataacttgtccggtcgtcttaccatgggcctgtgcgatagtttgaatacttggatgactgaaaatcgcatgcttaccttctgcaaatggcgcccaggcttcgacccgcacgtgttcattttgattaaagctgacctcgtctgcctgctgataccacggattaacttcgatctggttaacagccggttgcacagacatggtcagttccaagttctttagctgatccgcataaaaattggaaacaccaattgcgcgaatcttgccagcatggtaagcctcttctaaggcgcgccaggcccccatcacatcgccataaggttgatgcaaaagatacaagtctaagtagtctaagcctaaacgttgtaatgacgcatcaatgccttgcttggcacgttcataggtgaattctgagacccacagcttggaagtgacaaagagctcatcacgcttcagaccactcttttgaattgcccgccccactgcggtttcattttgatatgcggttgccgtatcaattaaacgataaccagcctttaaggctgcggtcaccgctgcttcacattcatccaggtcggggacttggaacacgccaaatcccaattggggcataaccacaccattgttcaatttcgttgttggaaccatcacgcatcaacctttcgctatttgattacaataaccagcatacccgcaaacctaatacttgaaaattactacttattcatactagtatacatatagcgcatactgctaacggaggttcctgatgattgaaaattatttactagaagaactgatcacattcgcccacgagcacacgttggctaagaccgcggccgcattaaacgtgacgcaaccaaccatcacgcgtggcatgcagaagttggaaacgatgcttgccgttcgcttgtttgatcgccagcctaatcgaattacactgacgcccactggccagttagctgctcagaaagctgaacgattattgacacaacaacgggcctttgtgaccaaaatctaaaactacgagcacagcttagtcacacgtaccgttgaaactaccctccctgggccgctcacattgctcgcccatctcaaaacagacgaacctaatacactccaggtaaaccaatcattgattaccgacgatcagattaatgagcatctcattagtcgccaggctagttttattttctctaatcaggagattctgacggccgacattgaatctcgtttcatcggttccgaaaatctcgtcgttcatttgcaacgattcatgtaccgtgcgaatcaacctagtatcaccttcgctgaactcaaaggcatcagctttgtagtcctgagtgcaatcggtatttggaaaaccattattcagcaagccatcccagatgccaagtttttataccagcctcaacgcacggcctttacagaaatcactaagtactctgattttccgtatttcagtactaactttactacgttggaccggcatccccagaataaccaaaacgatgatgataatcgggtcgctattccgattagcgatgatagtgctcatatgcccatctatgtcaactatctagttagcaaccgtcactcattaacgccactgttcacgcaatttgaagccgcctggccgaactaacctcaagcgtacgtccacatcttagtctggtggtgattattcaccgcttgcattcagatctggcacgacactcaatttcgaacgtcaaacacgtgctggttgctactaagcatccgtgtgtacgacgcgtctacaatatttgatttagcgaaactcttaatacccccaaaagtaaaatccattccgtaagcgcctatttaaaagcgtttatggaatggatttgtttgacagcaaatcacaataaataatatctcgaagccgtttagcagatttgaactgccgacctcttccttaccatggaagtgctctacctgctgagctaaaacggcgttaattgaccttttccagtataccaaaagcatgctcaaattcaaaccgtacttattgacgttcgacgtgtgagtaaaatcacacgcctttttttggtctttttttcggtaatgtggacaatatcgtgatagcgaatctgtccgacctttaagttaagaatatcgctcattcgaagtccagtatttaaaccaattagaattaacaacgcgttacgctcaccgtgcgtaccgttccgagccttattaacgaagtcagtgatttcttcattggaacgtaagggctcaacattgtagtaaatattaatcacactctttcgtgggacgtactaattatgactattaagtatcaattataaactatattaattaataaatataatcaaatatccagtacaatacccgattacacggataaacggcactattttaaaaaaaataatgccgtttcaacacaatctgtaatcaaatataacatcacatcaatatttgtcaatgtaatatgtcattttattgtatgaaaatagttgttttcggtgcagcatgcacaagtttagacaaattttagaaaaatatgtttgaatcattgatacaaaaggaatctttctttttattttaatgacgttacataaaatgtggttttaatctagttaattttggagagtgaatgatggatcaagcagtaagttttgacttttttattcggcttgtccgtaagtactggcgtgcaattgtcagttttacggtggtgggattgatagttgccgcagggttgaccttctttgtaattacgcctaagtaccaatcgagtgttcagattttggttaaccgtaagaatactaatgccgctactgagtacgctgggcagcaggctgacgttcagatgattacgacctacaaagaattaattgctggacaggtggttttaaaaccagctaagcaacaattaagtaaacgttatggtattgagcgctcactgaacacattgaaaagtgaagttagtgtgacaagcacgactaactcacaggttttctcgattgcagtgactgatgctgatgcgaaagctagtgcgacgattgctaatcaaattgcgcgtagttttaagaatcaagtacaaaagattattaaggtcaacaacgtcacgattgttgctccggccgaaacgccaaatgacgcagtatcgccgaagaagccgctgaatatgttgattgggctagttgttggcttgctattaggatttgtttatgcagcgattcggatgctcactgatcgccgcgttcacgacgctgatttcttaactgatgaattaggattgactagtttaggcttggttaaccatcaacatcatcattcaatgaagaaacaggccttgaatctgaatggtggctatcatacgcataatgatcgaacatcgtcacaagcgatgaaacgagtttaggagggtgttagatgtttaaacgtaaagaacagaatataacgactacggccccaattaatctcacgacgattaatgaacctatgtcggtcattactgagcagattaaaacaattcgaactaatatcaattttgcggctactgaccataagctacgaactttgatggtgacctcggccatgcttggcgagggcaaatcgacagtcagtggcaacttagcagtggagtatgccaaggaaggcatgcaagtcttattggtcgatgccgacttgcggcgaccaacgattcacaagacgttcgggcttaaaaaccataagggattaagttcatggttagccaatcagatggacgatgtgaatgatgcaattcatcccgttattggcaatctatttgtgatgacgagtggcccaaagccacctaacccggccgaactgttgggtagtaacaaaatgactgagtttttaacttcggcaacacgtaaattagatttggtgatcgttgacgcaccaccaattttgccggtgactgactcacaattgctcgctaataaagttgatggcacggtcttagttgttcgccaaggtgtagcccaaaaagtagcggttcgtgatgctgttaattcattaaagaaatcacaagctaacattttgggtacggtgttgaacgatgttcgtgatggctctcatcacggatactacggctataacagtggctacgggtactacagcgatgaagataaataatttagttgacttacattgccacatcttaccagccattgatgatggttcgccttccttaaaagcgtcattggaattagcacggcaggcggttgctgacgggattcgctatattttagcgacaccacatcatatggatcggcactatctcaatcatgccggtgatgtggctacggcggttaaggcatttcaagcagagctagatgtaaatgatattccgttaaccatttttcctggtcaagaggtacatctaaatggtcagttgatggaaaaagtggacgatttgttgggtatagataccggtagacactatttattgctagaacttccccacgagatggtaccaagttacttggatgagatgatttttcaattgtcttgtgaggggattaccccggtcattgcacaccctgaacggaatgctcaaattattgctgaaccgcaacgattatacaagttggctgaggatggggtcttggcacaggttacggccacgagtttagttggtacttttggggagcaagtccagcgaaccgcaaaagaattcgtaaagtgtggtttagttcaagtggtcgcatcagatgcgcatacgctgaaaaatcggggctttgctatgacgaaggcctatcaggtgttaaatgaaatggattcgaaatatcctgaacgttttgcaaccaacgctcgggatttgttgaatggtgaacagatcgatactgatgagattgtgatgcccagaaaacagcgaaagcattggttgttttaaaagaaggagcgagttaaatgaaagcattggtaactggaggagcaggatttattggttcccaccttgtggaccacttggttgcagaaggattggatgtagttgtggttgataacttgtccatgggggacttacataatgttaagcatcaggatgaagtcaccatttatgtcgaagatgttcgcaacgaaaagtttatgcaacagcttttacaagaagaacggcccgattatatttactttctagcagcagttgctagcgttgctgattcaattgaacgaccagcggaaacccattcagtcaatcaaacagcggtcttcaatatgttggaatatattcggaaaactaatctaccaattaaacagttcctatttacgtcttcggcagcggtttacggtaatcttccagaattgcctaagaaagaagactcacgagttgatccattatcaccatatgcgattgataagtatgctacggaacgttttgtactagcatatggtgaactttatgatttaccaactgtctgtgtgcgtttcttcaatgtttatggccctggtcaaaatcccagttcgccatattcaggggtgctgtcgctcttgaccgattgtctcaataacaagaagccatttaccttgtacggagacgggagtcagacacgagattttgtgtatgttgaagatgttatccaagcattatggctgataactaagagtaatacggagcatgaagtctttaatattgccaatggtaatgaaaccagtttaagtgccgttatcgaaacgtacgagaaagttgcggggacttcattacaggttaagaaagcgccggggcgtgaaggggaagttaagcgttcggtggctaacattggtaaattaattaagttgggatacacgacgaagtggtcgttagaatcgggtttgagcaaatattgggaaggggcgcaacgacgtgaagcaagtcgaaattaatgaaacagttaaagtgagtcatattcaaccacagacgaattatcagttcttaacgatgattggtcggcctgttactggttggaaattagttgtgaagcgaatttttgatttaattgttggcttgattggtaccgtgttgagttcaccaatcgtcttagtatttgcaatcttggtcaagctaacttccaaaggccccgcattttataaacaagagcgggtcggtctaatgggtaagagttttaacgttattaagctccggtcgatgtatcagaatgcagaagcacggaccggtgctgtttgggctcagaaaaatgatccccggattacgccggtgggccgccttatgcggaaaacacgaatagacgaattaccacaattttggaatgttttaagaggagatatgagtctggtagggccacggccagaacgtcccgtattaacagaagaatttagccagcaatttgtggaatttccaaagcgcttacgaatcattcctgggattactggatatgctcagattaacggtggctatgatattacaccggatgcaaaatgcaagttagataactattatattgaacatttttcggtctggtttgatattaaaatgttgttgggcaccgttaagattgtgtttactggggacggtgcacgatgattgccaatgcgaccggttatcaatatgcgggactcatgtcagtttacgtcaatgaaaagccgcaattgttggaacgtgctttaaagtcggtcctgaatcaggattatccaccagctgaatttgtattggtgaaagatgggaatttgacagaagcgcttgagtcagtgattcatgatgcacatcaattgtttgaacgtgccaatattcggtttgttgaattaaaaaatccggaaaacatcgggcttggacgttcgcttaacaagggattaaaagcatgtaccaacgaattagtggcgcgttttgattcaaatgatttgaacatgccacaaagaatgacaaagaccattgaatggttccacgaacatcctgatacggccattgtagggactcagatttatgagtttgatcaagatgaacagcatccttttgatgtcaaacaagttccgcttgactatcaacatattgtcaaacagagtgttgttcgtaatcccttcaatcacatgtcagtcacattcaaaaaatcagttattgatgaagttggtggctatgtggatgtgccgctttttgaagattactatttatggttacgtgttattcacgcgaaatatccggtcaccaacctagtcgatacgttagtaaaagcacatgtcaatcaagagtttgcacacaagcgcgggggtctacattacttaaagaaggaaatccattttcaaaacctattagtgcgggatggttttcttaaacgctcccaatacttacgtaatattttgattcgtggaactgctagattgttgccagctaatctcttattggttctatataaatttttgcgtaaattgtaaaaagccaagttatggtattgggagggaaaatgattatgcaagcagattttccaattgattttgtggtgacctgggttaataaccatgatgaagaatggcaacggaagaagtctaagtatgaacgaaagcaaccggaaagtcgtcaaaatgatgaaattgcccagaatcgttatcgtgattttggactttttaagtattggttccgttctattgaacaaaatgcgagttgggtccacaaaatatatattgtcacggatcatcaaataccagattttctaaatttggacaatcccaaaattaagattattgatcacagtgagattatcgacaaacaatttttaccaacttttgattctaatactattgattggaatttatttaagatttcggggctgagtgatcattttgtttattttaatgatgacttttttattaatcagcctgttcacccggaagatttcttttcaaaggatgggaaggcacgtgatacggttggtcaatcaattattatgccaattgaagggtacgatcatacgttggtgaataatacgatgaaaattaatcaattagttaataagcgtgaagtgctgaaaaaggaatggaagcagtttttctcggtcagacaaggcttatctgtgtttttgctgaatgcattcttaagcgtttttccgagatttacgagattatatgatgcacatactgcctactcatttattaaatcagatatggaagcagcttatcgccaacttgagccagaactaatagcaaacttttccgaaaaatttcgtacctcagatgattattccattcagtttgtacgctattaccagattattcttggacatgttgacgttcggagtatgtattttggtcagactgccaacacgaataatcctaaaaaaactgaacagctgttgtttgaacataaaaaggtaaaaattactaacgttaatgataccatcgatgcaactgaccgtgatttacaaaaaattattagcctatttaaacgccgttttccaaagacttcaagttttgaacgagttagctagtaagcttgactgcaccttattgcaaaggaagaacgtatgaaattatcaaaaaaacaactgagtgtactaccattggctgtatttctgatttatatgactatttacaatagctcatttaaattggtctttgtttcaaggctttggcagtacctagtttatggaatgtatattgtgctttatacactgtttattcttcaacaggtcggccaaacccaaaaagttaagcaatggttatatttatttgtgctgagcatattaatgttcttctatctgggaaaaggaaatttgaatgtggccgttatcttcttgttgggattatataccatcaatataatggacgtccgattagtgttgaaagtttatttaacctctttttttattgcttttgttgttgtgattggtttggtggtattgaaagttctgccaatttacgaagcaaaatacgggttgttagccatcggatttagaaatccaaatacgaccggattttattgtgcatgtatggtcatcatgcattggacactcaactggagtaaattatcgttaattaatttgtgcgagattcctgctgcgatagtcttactacttatgttggaagattttacggcacttttattgattgttcttgtcattctcatgaaagctatctcaccagttctcgtgcactttttgagagctagatggttcagttatggtttagtcctattaccagtaattttcttcggcgtgtgtctttggattggacataatttcaacaattatccatttttgtcacaattaaatgacatttttacgagcagaccttctatctggaactactatttggccaattatcaaatgaatttattaggaaatcagttggcagatgtcgttctcaccggggtcaattggacagtcggccgaggtgcatttgatggggaattcatcttctttccaatcattaatgggctactcgctttcgttagcgtgatgggattgttaatggtggcgtttaagaaaattatttggcataggcagtatgcgttattggcactatttttgatttatctaatttccggtatttcagagaatcaattgcttatcccctatcaatgtccagttgcagtattaatggtattgatttgttatccagagtttagttttgagaggaaatcagatgacgtcaaagaagaagattatgattgtgactgggccaatggcaggtcacggcggagaagaaagcgtaattacgagttttattaatcaccttgccaatacgtatgattttgagttgtatgtatcacaaatcatgggtgattctgcgtggctcaagcagattgataagcgtactaaaattacaattggtaccgcagggacaaggagaataactaaggccggtaagctactcctacacatatgccggtgccattctgatgcagtaattgtctttacacctagattattgtttttgatcaatcttgccagaaagctgtattttcgccattttaaactgatctcatgggttcaattttcgataaatgattatttttcgactcgtgaccgaagctatttagcgttggcggatgaacatttggcaattagtggtgggattaaacaacagttgatggatattggaattaatcagtcccggattcatttaatctataaccccattcctaaaagcaatcaaattattttgcctgaaaatcaggtagtgaattttatttatgttgctcgtattcagtttaatcaacaaaaaaacatgcaggccctatttgacgcctgtttgcagctgaagggcgcttggaaattacacatctatggaacagatacgactgcgaatcaggatgaatatcgacagtgtatagtgtatatcaaaaaactacaaattgagtcacacattatttggcatggttgggtcgccaatgtatgggagaaaattgaacatgcggatgctcttgtcttgagctcaacttctgagggttttgggatggttcttgcagaagcgataagtcgggggattccagctatatcatttgattgtccagttggtccggctgacatcatcaataaaaataatggttttttaatcaataatcgtgatgtaatgcaatttgcagctattatgcaaaagtttgtggatagagaggttcacttttcggcagctcaagtaaaacaaagtattaccaatctatacgaggatgtctattatcggcgaactgccaagctactaaataaattgttataggaggtggattatttggataaaattgattttgtcattagctgggttgattcagaggactcagaatggcaaaaaaagaaacaggcttattctggaaagaaaattgtgaatagcagcaatggggacgaacggtttcgtgactatggaacgcttcgttatttattacgatcaattgaaaagtatgccaactgggtgaatcatatctatttagtcactgaccatcagcgcccaaattggttgagtacgagcaatccacggctgactgtaatcgatcatcaagatattataccagccacggcgctaccaacatttaattccaatgctattgatttttgtttagaccgaattcctggcctgtcagaacagtttgtctattttaatgatgattttttgataaataagaacgttgcacccactgatttcttcaagaatgggttgccacgtgatttccgtatttatagtcgattgattccaaacagcgattttgatcttctcttattcaataacatactctgcattaatcagtggctgaagggacaacggcagagtgttaatggtatgttttcacgaacatatgggcttagaggaaatatcaagaatttagtccaaatagttcgtaatggtggtcaagtctcgaattatgtgctgtaccataacgcctattcattcacaaaatccgagtatcgagcagctaaaaaaatgtggcaacaaaaaatacagcaaaccgtgagccaccgtttcagaacgcatgatgacgtcacggtatacttgatacgatatttccgcttggaaaaaggggcttttgcgccgaagagtcctaaatttgatgcgtattatacgttaaatcagacccacgcactaattaatgaattaacacattctaagcaccatttggtttgtgttaatgatgctgatacaactgattatgttgataagaagaccaagttagtttgcgcgctaaatgaaaagtttgcacaacaatcagattttgaaaggtaatttgcataatgggagagaaaacaactggccgttggagaaaggcatttgtcaattcaacagtcttgacattattacaagtgctgacaattattttgcggtttgtcaatcagacattctttattcaggtattgggtaaagagtttttgggtttaaatggtctgttcactaatttactgacttatttatcatttgcagagcttggtgtcgggacttcaattgtcttttcgctatataagcctatttatgataggaattataagaaaatatctgcactgatgaactttataaagcgtgcctatactagtatcgggctagttattttagtacttggagttggtttgattccgttgtttccatatatcataaaaaattatggtgatgtcgaacatattccaatttattttttgctatatttgagtaattcagtcgtaagttatttttttacgtataagcgttctattttgattgcagatcaaaaagaatacaagagttctatgaacactttcaagtacaccttattacagaccatactacaaattattgtcttatacttctttaaggcctattcactttatttgattgtcgcgaccctttgtacactaatttctaacttgtctatttcagcattggtgaaccgtgagtatccctatctcaaggaaaacactaaattacgattaagtcgattcgacatcagacagattcgcagtaatattattggcatggtcggatcccggattgggagtatcgtggtacgctccactgataatctattattatcagcatttatggggttggcaatcgtcggtatttattcaaattatttattgattgtgaccagtgttagcacaatcttatcaaagttagttagctcagtaacagcaagtattggtaatttgattgcagaaaaggacgcaacgaaaagcctttttatatacaagactcatttttatattaatttagttatgacgacaattactgcagcttgtttgttggttgccttgaacccgtttgtgcaggcttgggcgggaaaaaactatgtgctgaccagcagcaccgtgattgtgattgtcttaaattacttcattgatcagttgcgacagtcttcgattgtattcgtttctgcatatggattatttgtaccaaacggtaaaaagtcagtagttgaagcgttgattaattttattttatcgttcatcttactgaccgtctttcatcttggcataaagggtgtcctgattggaacgattttgactaacctgcttgttaattcttggtttgagccattaattatcttcaaaaaagggtttgtaattaaaggtcagtttaaggccttctatttaaaaacttattttggcaatttagtcttgatgggagggatgattggtgcattggcttggcttattttggggatagatacgtatttgaattggccatcgttggctatcgcaatcattaatgttgttttgattgtgatgtttatgatagtaatcattattggtatctatcatcgtcaagagaattttgtttatatcaagaacacgttacttaaaagaatactaaagtaaaccagggcggagaatgtttcaatgaaaaagcaaagaagttcaaatattgaactattgagaatcattgccatgttcttgattgttctgcatcacgcaattgttcatggtggactggataagacactgataaagttttacacaattccaaatttcttagcacatgggttcacaattttttcattacaatcgctggttatcttcggtaagatgggcgttgcaatttttgtcctaattactggctatttcatggtttattcacaagctagatttgtgaaggtgatcaagacttggttggtcatttttatttattctttgggattgtttttaatctcccttgctatgaatgtacaaaacttttcaatagctggtctggttaagtcaattttaccagtgattttcagtaattattggtttatgacaagttatgttgtcatgtatttgtttataccagcactcaatacttttctgaataaagcaacgaaaagcatacgccgatgtgttattgagttactgtttttgatcaacgttattttaccgattctttttgccacaatgcctgacaatgcagttgctttgggtgcaactaatgtaactagttttatattgttatatctaatcggtgctgaaatgcgttttcggcaactactgcagccacggtaccgcttggtgagtcgcactcttttctgggggtcactacttggatatattgcctcaattgcctgtttagatggacttggactaataactaaaaaagcattttttattgagcatgcgacggtcctatctggtacaggtagtaatggtgtttttgcattgggaatggcggttggtttatttgtcattgttggaacaagaacaatcaaaagacggaaaagtattaatctgctggcaacgtcaacgctatcggtgtatctgatacacgataatccatatatcagatcttggttatggcatacagtatttcgattgggaacactttctacgacagtatggtggctgagtattgttcgactagtagttgtgacaatgattgtttatgtggtcgcaacactcattgatctgacaagacaaggcctgtttaatcgaatggagaatcagttttgttcgtgggcagccaatcggattaacgttatgaatcgtggcattgagggaaaagcgcgcctggtaatgaccaaatttaccaggtgataagttattaggctattacaggcgaatctgaattgggcgagctagccaagtgaagcggttgttggtagcagttatcagttattttactatggaagcttgttataaaatgttttggacgggagaaagctacggtgaggttgtttttaatcatcacagagctaattgtgccgtttcgataacgcgtgttaaaaagaatcatttgataacggggagttatatttataaaatgattgtcaataatattgatatcatacatgtggtagttaaagagcggattatgaatacgaatataattggcaggcgcggttgcatggattgcgagaaaatgattattagcaattgttagccgattaacaccacgaaagttaataatacccgtgtcgatattggcttgaggtcgagcatcaacaacctgattattagtaaaatggatatcatggataatcccagcttttccgttattgtaagttacgtgttcaccaattgggttaggagcatagtagcgaattttataatgattcataattggcaagaaacgactgtgctgaacgtaaatgttatatgagggcaggttatcataattgtcaccggcaagtgaatatgacattgctgcaagattagagtagtcaatttggatgccttctttgaattgatcttgcggattactattgaatccccaaaaacttgaatgatcgactaggatgtttcgactaccatcaatatcgagaaaatgtccattgggcttttcacaattataaaaggtactatctaaaaattttacttgttgcgcatgatgtaagctttgggtaaatgagctctgaccttggttatcacttccgataaaagttgcattatcccacacaatatttttaattccaccgttatagcctttgtggggactaggatagacaaaatataaagcaccttggttgattttgaaactggcgccctttgcaaaatcaaattttaaattagaccgtagtttaatggtgccgggcttgaaaagatattgacctgcggagatgttaattgttgttgtcccactgtgtggtatatcgacaattttttgtaagactgaattgttgtcatcgtttgaaggtaatagtccttcagcgtgtgcgtcaataagagtatcggctgtgattcgctgagagttagttggtattaaagtaatcaagattattggataactgacaagtagactgaatcgaattagtttgggattaatcatagtcttcagctcctagcgtttatgagtgttaatcacaacaattggcacgagtcattgtgctgagtgtaggtcacatcgttgtttttctcaaatatatctggatggtattgacgaagaaaagctggatcttgtcagagtgatgattaatttaattgtcgtatcaactacctacgttagcggatggttattaaatacaatagtattggagggatacagatggtgtcaaaaaataatgataaaacgatgtttgccatgcgaattaataaagcagaaaaagaccaactcaaattgttgtataaggatatgggactggacctttcaactgcggtcaatctatttttcaagcagagcttattggagaacgggttaccatttcgtccgacacgggcaacagacagtaatgcagaaagaaagtaaatgtggcgggaattaggctacatttttagtgattaataacttgtactgatttgtttgtagaaaaggcctgagatttgcgtatcaatgaagtgataagcaaatctcaggcccttttctgtgaaaagagcgaggattataaaggcccggatttaaaatctaagtgcaacacctaaaaaactagaccaaaaaggtcatgaagacctattcttaaatcaaccacgaactaagaaagggatgtcttcatgacccataaccagaataccattacttgtcactaccaacaactccaaccttacgaacgtggcctgattatggcccggcaatctgacggctggtcttgccggcgaatcgcccgcgaacttcatcgcaaccctagtaccatcagtcgtgaactgaaacgcgggacaatccggcaaatcggtgctaaccataagccttttatggcctattttgctgagaccgcccaagttgtttatgataaccaccgtgcggcttgccacgcggtcagttggttactaaaggctcccgaatttttccgtcagttggtgattgaattacgccgtaaaccgcgcgtccacagtatcgactcttttgtccactggtttaagatgcatcgatccaaattaccgtgtccttcgacacccacggtttaccgttacattgacgaaggccggttagaactgactaatagtgagctcccgatgaagttacgccgacggataaagtcggcccataagacccaccagcgcatgaataagcgctctttaggccagtccatcgaagaccggccaaccgcggtgaatggtcgtatggaagtcggccattgggaaggcgatttagtcaagggtaagcgagttgccagtgaaccagccatcatgactttgactgaacgggctagtcgctacgaaattattgtgaagattaaggactaccacgctgagacctgtcgtcaagcgcttcaagacatcattgacgactacggtccagaacacttcaaaaccgtgacctttgacaatggctcggagtttgcgaacctgtcccaagtgactggtacaacggtctatttcgcccacccatactcaccctgggaacggggatccaatgaaaaccaaaaccagttgattcgcgagttcattcccaaaggacggtcgatgcggtccttgaccatcaccggaattcaagcgattcaagatgctttgaatcaacgaccacggcgaattctcggctatcaatcagctaaggatgtcctgccagactttgattaactagaccactgtttaagaataggttgtaagtgttgcacttgatttgacaattcgtgtttatattaaatctagccataacacgtttattaactttgaagggaagctatcaatgtcaattagttcattgagtcatatttgtgttatattgttcatttctttcagtatttattatagtgtttggagcttaataggcgccgctttaactcacatattagtgtataatttttaataaataagtaccaagggatgaggtggttttgatgcaatggcaaccgctttttcaacagcaagtactaacacgtgcgttcaattattatcaagaaggccatgtcagaaaattcagcaaggatcggcataagcttatggcggtagtgcagggggggcaggattatcaggttacgatttttgaaagcaatggtgacgttagtacgatgatttgcaattgtccatatgctcgttctggtcagcattgcaagcatatggctgcagtgttatattatgcggaaaatactacgagcgttggtagtcagcctaagatgaattcacctaagaattgtcaggaaaagttattcaaggaatcggatgataggggtggcaacgaatggaactcggatctcatacaagatattcgaagttttaccttgagccagggtaagttgttagctcatgaagatatgctagcagttaatccatgtccattatttacaccacttgcggatttaccaatgttattcaactcttgtgaatggttggtatcaaccgaactaccgagaatgcttgctgctaatcagcaacaaatggtctttgatatattgacttatgcgtacttgaagttatgttacaccggcgttgatcaaactaatctgattgatgagtgtgcctgtctattcaggcagttactaacacatgccaacggtcatattcgccgatcaatctttcggtggctattcatatatagtctggcattgccaattaagtatagctcacagtttgagctgctattgttttatagtgatgctttcagtaatccatggtttcttaatcaaaagttgatattggttgaccacaaaatcagcaagcttcaagccagtcatcatgaaatgcaatttcaagtcgaaactaccgtaattgaatggcaacgttatcgtatccatgttatgaaagagctgaaattatcgccaaatactgtccaagaattctgccagttgaatcgtgatgatttagttgttagtgattattttgttgagaattgtcgtgggcacaacgatatagaacgtgccatcatgtattgtcgtactgggattcagcaagcggcgcaggatgacaattcgactgtcatgtaccattgctatgaccagttagtctcactctatcgagattgtggtttggtgaacgaataccggcacgcgttgtttgaagcaatcaccaaatgtgatgctttgaattctaactggtacattcagcttcgagagcagtattccccagcagattggtcgaatgtgcgtcgtcagattagtgctagcataattccgcaagctgattttgaatgggacagttttcaaaatgtgtttgtaaggccgtatgtactggctttgcagcgagatgtaaagaaagcaacgacacctgagagtcagctttcaatcattaagcaactagaatatctacaaaagtatcatggttcgaccgggttagaggtagcagattggcttttgaagaattggtatcgacactatcctgaacgtaaagtgttgatagatgcattggacgaacggatcgcgcagaaaattgaaaaagattaagaaagtagtgcatcacaaaattaggttcggtaactagtttcgtgatgtgctttttgaatttactttgtaatcaatacatatttttgaaatgataggcatctttccaaaccaaccgccaaatacgtttaatccccttaaaaatcaggtttaaatattttatcctaaccatcacgtctagctataatcaaactagactagtataatgaaaaattacttgaaacggctagtcagtttaactgactaattcggattagttttaagtgatcataacaatttgggggaagcttatgacaaaaattgcgtgtgtgattgtgacttttaatcgtaaagcgctacttgcggaggctattgagagtgtcttgacgcagccggaagcgccagaatatgtcttcgtcatcgataacgcatcgacggatgggacggaggcatttattcagcaacaatttgactttgatgatcaacacttggtttacgttcgttgtcagcaaaatcttggtggttccgctggttttgcaactggaatccggctagcattgcagactgactgtgattggatctcgatttctgatgatgatgcgatttttcagaccggctactttgcggcgatgcggcgagcgattgtgactcagccgcaacaaggcgtattttcaggatcagtgttattaccaaatggacaccatgatgcgatgcatcgtgaaatgattaccaattcgcaaacactgacggttaagcccatagccgaagccgactatgcgcaggactttaagtatgatattttttcgtttgtgggtatcttaatgagtcgcggcattgttgaacgaattgggttacctgaacaggattactttattcggtttgatgactttgaatatgcgctccgggctcgcaagtatggtcagtttctaaatgtccacgacgcgttggtcctacacaaaacgacgtatactcgtactgctatagcgccgtggaaggaatattacgtgatgcgtaatcggctggcatcattattcaaacaccgtgggcaaactcgggttacctgctggtatgcccgtcgttttttagcgcgcaaattattcgccatcttgctttttcgggatagatggggccaagcggggccactgataaaagcgtatgttcaaggttaccgtgatggttggcatgaccggcttgggcgcaatcaagattatttaccataaaggacgttaggctaagacaaggagtggacaaacatgcaatatggggcgattgtggtaactttcaaccgcaaacaattactaatcgaatcaattacggcactactgaatcagacggtcccacccgcgaaaattataattattgataatcattcggcggatggtacaaaagctgaattacaaacagctgatattttggctaatccaagtgttgattaccggtatttgaccaaaaatatcggtggtgctgggggctttgctcgggggatgcagattgcggcggcagatccgaacttggattggatttcaatgtccgatgatgatgcaatttttgagccagactattttgaaaaactaattgcttatcagcaaaatcatccaaatcgccaaatcttgacggggagtgtgtatattgaggatggccgtttgcaagcggatcagcggaaccggttcaccaattggagtacctttcaagcgcaggcggtccctgaaagtgaatatcgcggtaattttgagtttgaccagtacactttctgcggtgttttcatgagtgtggctgtgatcaagcaagtgggagtggcggacgctggctactttatctggtgggatgactgtgagtacgcggtacggacggccaagctgagtcgaccggtcaatgtgagtgcggctaaattaattcacaagacggctttaccttccctggacttcaagtctaaattcgtacccgattggcgtctctattacgggcagcgcaatcgcttgattacgattaagcggtggcgtgcaaactcattggtcagtctcggatggttgcttggattctacgcccgattggccattcaactctgtggaccgttttatcgtggctatcgcaaaatggttatcagagtttacttggaggcgttacgtgatgcgagtcgcgagcgtgagggcttgaatcccaacttcatgccgggacagaagttttagtgtgggcctgatcgtgagctgtctgatgacatgggaaccgtatacaggcgaaaccagtgattattgcaatttaaggtcagattactaaaccaggccgactcaattttggacatcagcttcatcattattaacaacgaattaaaagctagttgtgctgagaaaaaacttcttggcacaactagttttgtgttttggtgacattttagacggaaaagcaaaatttaatttttagatttattttgtaattcgaatggataattttactgtttttacagcaacgtttattggtcttttgaccagtgactactagcaagcattcagatgattgcttgtatttagtcgcaatggttgaaaccggtaatcataatattatttgttatttagatagtaaacttaatttagcaagccctgatatttgattaaaacccgttatatccgtatgttgagcgattgtttatcacgtaatgtttgttataattcaccaagaacaagttaattttgggggaattcacatgaacgaacaatacgattatttggtagttggtgcgggactatttggtgccgtctttgctcatgaagcagccttacgcggtaaacgggtcaaagtgattgaaaagcgcgaccacattgctggtaatatctacactaaggaagtggcggggattcaagtccaccaatacggggcgcatatcttccacacttcggatcgtgaaatttgggattacgttaatcaatttgcggaatttaaccgttatacgaatagcccagtcgctaattacaagggtcacatgtacaacttgccgttcaacatgaatacgttcagtgaactctggggcgttcggacaccggcagaagccgccgctaagattgcggaacaacgcgcggcggcgaatctcggtgatcaccaaccacgcaacttggaggaacaagcaattgcgttgattgggaccgatatttacgaaaagctgatcaagggttatacggaaaagcagtggggacaaaaggctacggatttaccagcgttcattattcggcggttaccggtacgctacacttacgataacaattactttaacgatacttatcaagggattcccatcggtggttatacgcagatcgttgagaagatgttagctcatcctgaaattaccgtggaaacgagcaccgacttctttgcgcataaggctgagtatcttgcccaatacccgaaagtcgtctttaccgggatgattgaccaattctttgactatcagttaggggaattagcctaccgttcactacgttttgagactgaaaccgtgcccgtggataattatcaaggtaatgccgtagtcaattacactgatgctgagacgccgtatacccgggttatcgaacacaaacactttgagttcggtaagggcgatgcggatcaaactgtaattacacgtgaatttccagcgaactggcagcggggtgacgagccgtattatccggtcaataatcaaaccaacaatacgctctacaaacagtatgcgaagctcgccgcggctgaaccccaagtcatctttggtggtcgactaggccagtatcgctactatgacatgcaccaagtgattcacgcggccttagtgacagtcgcgtcggaatttgcaacgaccaaataaaagaatgtgtgatgattgaagatgagaaaacggctagcaattgtgtgggggagcctagcattgctcgcactattattgggatatgcttgctacgccctgagtattcagcgcggtcaagacacggtcacgcggatttatcaaactgatcaaaatgggacgccgattatttcacccggaccaattaccttagtaggtaaggtcaatcaccgcaatttatttcagtctggcattaacggctatgtcttaacgaatcgcgatccattggcgactttgttgccgcgccgtaatcaaacagtgcatctaaagtatcgttctgcacagacgacggtggagctacgcaagacgctacgtcaagcacggtatttacaggccggtactcagaataccgccacgccggtctttcaaaatcgacagcagcgtggtgatgcgacaacgtacggtcgtatcagtaccagccaagacggccggatatggacgaaactacccattagttatccgcacgtgcaattgtcgcggccgagtgtctggtacgcgaatggccgcttgacgttgatagatgggcaagaccgttactggacgactaattttaaagattggcaacatcaacggttgaaccttaacggggcagattttaggcgaggtcgggttcaggccgtctttccaggtacgactcgttcagcggttgttatggttcgcggcattgatcgccaaagcagtcgcgccaaactctattatggacagctcacgaagactggacgggtcaaagcttggcacgcgttacaactaggaaagctcccagcgcgccaagtcgctggaatgagcttgattgatcaacacttatacctgtttcgtcagcgtggtacgcgtttgaccatctatcgtgccaagcggttgacgcgtccggtcaagttggttggtcacgttaagctaaatcatgcgcagtcacaacgcgtgaccgcggtgaatttgataccgaccaccaagcatcgctaccggctaatatttgacttaacgacagctgaaaaggttcagaaacagccacgttatcggttgctggatcggcgatttaaagcagtggggcagcagcatctattggtcactgattatctctggagccaatttcaaattagtctacgtgggagtgagtgaggcacatgaaggtacagccaaaggaacgctttagtttagcgtggcggtggttgccgctcgaattgctgatcattatgctaagcgtcggccttggatgggcgggcaatcgatggctacctaagccggtgtatcaagcatctgttgatattcagattgcgcaaacgccgcgttcagggctgtcaacagcccgtctaaaacgtcagcgacgccaggatatcaaagctatcacgcagttcaacgtgatgccacaccagagtgcagtgctgactcaagccagcacttatgcctatgcgcattatggcatttggcaaccgattcaggaactgagtgagtcggtccaagcggcaccagttgcgcggcgaccggtcttacgggtgacagcaacgagtagttcacggcaagtggcccagcagaatgctcaggcgttcaatgtggcgattaaagctaatctgacgggcttaaaaaattatcgagtgaagacagttaaacgtaccgtaacgcgtgagacaaacgtgattcgcggggcgctttggaagttaatattagttgttgggggcggcttagcgttgctgagtccgtacctcgtgaaatatggtcagggttgggggcggcacgataatgagacgtaggggagcaagtttacagcagtaccgtaatacgctctatctgattatctttggaatctacttagcctcagtcacactgcaaacgacgacctttaacgagctgataccacatcgagtgggcgttttgattgaattagcgactttggctgcattactgggcctcgtggtttgcttagatgccttgactcccggccagattattggcgaagtcagtttactcgtgctggtgactgtcgtgacgctcacatcgggtgcgcattatttgatgccgacaatcatgttggtgattgcggcccgggaagtttcgtttcggcagatcattcaagtttatctgggcgtcgtggggacgattctcttgttagcgctagttgctgcggaagtcggactgattaaaaatattacgtttgcaactgccgatgggttacgtcagtcgtttggtgtcgtgtataccactgattttgcggcccatattttctatctgtgtgcggcgtatttatacttactggcccgtcgttttcgattagtagcgctattacccgtgttgcttggcctggcaatgatttaccagtttacgaaaacgatgacggatgtgattgctttactcgttttgatcagcttgtacttggtctatatctatcgccgccagcttcggtggcttcggccgatgattcggtatagctttttgatgttaccacttgctagtgggctcattattgggttgtcgaatatttttaattatcaagaccggatgctggtatggctaaataatttattttcaatacgattatctttggggaacaacgcactgtcggcttatggagttaaaatgttgggccagtcacctattccaatcaatggatggggtggagaccgtgggcagacagtagcaagtggtgtcggtgatgcaacgtatttcttcatcgactcgtcattcttaaatatgttgatttcatacggattactattaacgttgattataattatcggtatgacctggtttttgtatcaacggacgcggcaacacgattatttgttaccggtaatctttgcggccattgccatcagtagcatgtttgatcagcatttcttagaagtaacgtataacgtctttattctgatgttattcgctgatttaccaaattatcgaacggcagtcggtcccgcatttgaccgaccagtcgttattcgaagggggcgtcgtgccgatgaatcatcaacaggcttatcgggtgcagcggttgatcctgatcatcgccctgatgttaattctattcggtgataccgggatgaacgcggtatttagttttagccatcaaccacaaagtatctggttctatccgcagctcgtcgttgcattgataacggcagcgggtcccaacttattgttgatggccctgggcgcctatcaattgcggcgcacggcattgaccgtgccacagttgattcgccgagtcttatggataatgggtggaattaccttattctcactagccttctatcttgaagacttggtcacccaaggtagtttaacgagttttaacatcgctggcttttttaccgctttagcccaagcgcccgtgggcttttatgacattttgtatgagctgttgggcttctttgtcaccttgccgctattcagggtgattgcgcaccatgccagtcttgcgattcagcaatacctattttgggcggagctcgtatttattggcatggtaccaatcttggtctactttactggtctgacgacgatcagtgttaatccaccgctcgcgattacggccggttgcttttttgcattgatggggtattggttgagccaaacggaggtgttacaccggattacgcgagaacacctcttagtggcgtggctgctgacatgtgggtgctatgccgtgatggtgtcggtcacgatgtatcaagtgaatctagaaaagaattttgaccttatcagcagccagccgtttgcccagacttttcaggcgattccgtgtttgacactgtgggtgacgattgccacttggatcatgaatcgaccacggtccaaagcagttcgtcggcataactttgttcaaacgggctatggtgatttactggtggccggtctactgatggcaccatttatggtcattaatcggttgctaacaccgattatcggcgcgtggtggtctggttggctttggactagcgcggtgctgattgttagtgtcgaactggtatagttattacgacacgttcgctggttgcagcggttattaccagatttatttggcggctctcagtcaataggaggctcagtcaatgcgcaaaagaattgagtggatcgatattgcaaagggaatcgcaattttagcggtcgtgattggtcataccttgggtccctataacgggcaattcttcggtagtttgatcttcgcctttcacatgccgattttcttcatgttgagcggttatttatatcactcacgcccggcacgacaagaatgtcagcgtggtatcatcaacctattactaccgtatctcgcaacggcagttgtgctgttagtcgtaagtgcgatagcccggttattgccgaatccgctccttagtgcgtattttccaagttggcgtcaaggattagttgccacggcatacggggctggttcggtcgtcttcaatccgtggcactggcaagttcaaccgattggggccgtgtggttcttgctcagtatgtttatcgcactgcaactgttcaatggtgtgatgttactgacgtcccgacgtcatcagcgcttccgtcaggccatcgtgcggggcggggtgttcgctgttctcgcaatcttgggtggttggcttggtcatgtcgcttatttaccgtgggcctttaacgccgcgttgttagcacagctctttttatatgctggttacctcgttaaacaaacggcgttgctcagtcgaatgtcatctgcttggtatttattattcacgttcatgtggttagtgagtgcttttcaaggttattttgcgttgacggtcccaacgtcgcctaatctgttgattagcgtcatggggggcgttgctggcagtttgtgtatcattcgcgtcagtgactggcttagtcattatccgaatgcacgcccggttaagtggttgaaacgctacggccagttatcgctggtggtgctgtgtttccatttgatcgacctaaacgtgattggcattgaaggctggttgacgaatcatttgattgcgcagacgggaccactcgtgacaacgctcatcgcaatcagctaccggattggttttgtgacggttgccatgctggcaattccgcatcttccgggaattcgagcgtgctttttacctcggcagtatctctttcgtcggctacaacgtcgttagattagtatgtacaacccggtaaacaccgagataattaattgacctaacagacacgggtaaacacttgcatgattaaataatggaaaatttattatgatttgaggcacaaatttcacaccagagggggactggcgaatgaaagtacaaatttatgtagcggctcataagccgtatcaaatgccactagatccagcttaccgaccgatttttgttggtgcggcgatccatggggcagcaccgcaaagttatcaacctgatgacgtcggtgacaatatttcagcaagcaacccgaactttaacgagttaacggcgatgtactggatctggaagaactgtcatgcggatgttaagggcttgaatcaatatcgacgctacttgtctgaggcacctaaacgcaagttagccggtattttatcaaggaccgaaattgaaagtttattgcagcgatacgatgtcatcgtcccgaaaaagcgccattactatattgaatcaaattattcacattatgttcacgcacatcatcgcgaaccactagacatgatgcgcacggtgattagtgaacgccatgccgcctacttagatgactttgatcagttgatgcatcaaacgtcggcgcacatgtttaatatgatgatcatgtcggggcctaagtttgacgactatgccaagtgggtctttgatattctgtttgctgtgcgtgatcgcattgatatcacagattatgatgttcaagaggctcgcgttttcggctacctatccgagttcctactggatgtatggatcaaccacaaccaacttacgtatgtggaagtcccggtaatgtatatggaaaagcagcagttaccggcgaaagcgtataatctgttgaaacgaaagttcttcccacaagcggctaagcggacccacttttaaggtgtctgcgatttatcacggacaagtgagggcagtcgctgatgaatgatgcggcatgcaaattaatgagataacgacttaatagtttaaaaatgcgccactcactagacgatgatcggtctagtgagtggcgcatgttaagtctgttgtataaattcgtaattgaacgtaggggttattacattcgggttcgcaacttcatagcattagtcagtactggcggctgaagcaggaacaatagtccgacgtaaatcagggcaccaatgccaatctgcaaggccagattaaggtaagaagcggtcatactgatgttcaaggcgtaaacgacggcgaacatgaccacaccggcgagcacgtacttcaaactacccgtaaataattgtctggtcgccaacgtatgtcgagtcacgactaactgatagccagtgacacaaacttccgaaatcaaggtggcgcacatggcaccggccacgccccaaaaccaaataagtgggatgttgcaagcgatgttgaccagggccccgatagtgacggaaagcgtataggtcttggtctgcttagtcggtagtagaaactgctgaccaagcacgttgctcatcccaattaggatgatgacgggtgcttcaatcatcagcagtcggtcgactgccccaaatgcccgtccaaagaagaggggggcgagcgtcgttgcgaccgctgccacaccgagagccattggaatcgcaatcgcgagcacaaagtcaaaggacatgtataagtattgtttgacgcgttcaagttgctgcttcatgaagaggttggcaatgtgaggcaacatgaccgtccccgttgccgtcactagtgctaaaacgagcttgatcaacttgtcagagtaatcgtaaaatccggcggcggtcagcgaatccatctgccataacatggtcttattcaacgcaaggtagaccgtcgtggcgatttgtggcacgaataacgctaatgagggccgcagatgccgaaagagattcaatcgtcgccagtgcggtcgatcgacactatgccgtaagtatggccacagcgtcagattgcctagcacttgtgagcccgctaaaatcagaatgtagattccggtatcttggcgagtcttcacgaatatgaagatcgcaatcacagaagcaatcttaacgagcatgttacggagcacagttttcttgaaatcctcgagacccatgaagtaccaagaaatatcaacagcacccgcaataatataaaatgattgatagaaaaaataaatttgcaattggtgctcaaaaaagagaaaaaccaaaaaggcgagataggcacaactgatggtcaataactgtaatatttcaatttcccaaaaagtttgtgagcgttgcttccgattgtcgcgaataaaggcaatttcgcggttaccataaatcgtaatgccgactgtcccgaacaatagaaagtaggtaataatcgaattggtcgttgcattgataccgacgccggtcggtcctaagacccgcgagatgtacgggacggttaggaggggcgttagtaatattaagaggttataccccgctgtataaaagtaattccttatgattcgcatgagtggctccttgtggcaattaagcagtctaacgttgaatttctcaacattcaattcattgtatcacagccaattagccggttgatagtggttttaactggctagggttggttattaacaaacttattattttataaattcgaaagtattgttattgttaatctgctgaaaagcaacatcgttatatcaacgataattaaattaggaagctagcttaatacttggagaactccagtgagtgatggtcgtgcacacgataattaaggactgaaagatttcgccggtagggtcgagtaatcaatgatgcttgcaggaaagcggaataaccttgatggtacggcgcgcgaatgatgcgtggcctgatcaaatcaatgggttacaaaaacgcgcaaccaaattcccccttgagtttggttgcgcgttcgtatttttatgtttagtaagcgccattaggcttgaacataatgaccacggtcttgaacagaatgtagacatcaaatgcgacactccgtttagaaatgtaagttaagtctaacttaaccatttcatcaaaaccgacactgttacgaacggttgcttgccatagaccggtacaacctggcttgacagctaagcgttgtttgtcatagtcggaatattcttcgacttcccgtggcaatggcggccggggtcccactaagctcatcgagccttgtaggacgtttagcaattgtggtagctcatcaatgctatacttacggatgaagcgcccaatcttagttacgcgtggatcatcctgcatcttgaacatggcaccatcaatctcgttatctttaagtaatttttccaacaattcgtcggcgttggaaaccatcgagcgaaatttatacatcttgaatgggacttcgccacgacccaaccgtgtctgcgagtagaagacggcgcctttaggatcttcaactttaatcgcaattgcgattatcaagaagagtggtgataagatgatgaggcctaagaggctagcgacaaagtcaaacacgcgtttaatgaaccgataaccataacgacgatgctgacgcccggcgtcaatcgtaatcggtctgatttctcgttccttcaattccataagtaacaccctatgcttcctttaaatatttcccccgtaaatcacagccagattaatctattactactgttcgggttaccacaaactgactatgtatgaaccatattgatacaacctaatgattatagtacaaaatagctatcaagtaaatatgcttgatacgattaactttgcggtcttgttaatcccattatagcaaatattgtgcaggaataaaccaatatttggggtgcggacgcgtcacggtcggttttgtgacttgggcagcggaaattggttaactataatttaccagcattttgacaagttgcaattattaacaacttaaaaccggataactgtgactaaaagtgatgcgttgtaaacttagttaatgaacagaaacgccacgggtcgcgtgcgaacaggcagtcgtaaattgaacgattgttctagtaattggtcacaatccctgatagtcggcgtgggacacacctagcttgcaagtatacgattagcccgaccgcctttgattgtcgggctgtggggttaatcctagcaaaaataattaagtctccgcccacacattccccctaggttttcctcaccgttcaaggtacaattaaattagagctcaaattcaagtgaaaaggatgtccgatatgaatgacgattggatcacggtttttcccgcggattataataattcgtaccacttaattttgaaacgggggacggcccattatgcgtactactactttaaggttgataagctagatcaacgggtcattttctatgatgacattgagcgtagcggtatttcgatcaagactcagatcacgcggacgtttatgcgagcactggttaaagcgattgattggcatccagttggtaacagtattattatcgagatttatcccgtcgcccgtcaagagacgaaggcgatgcggctatcttgtgatatttagctctgaagtgattgccaagagtaagacgactttaaatgatagccaaagaatccccggtcagttactgaccggggattcttgtaattgcaggtaacgcgaggttaagcttttggtgcggtgatgattggcgtctcgatggtttcgacgtacttagcagcgagtggttcggcgactaagttttcaccgtctttaacgaagagcttagtggcagcaaggtccgccattgcctggctaacgacttccttacttaagttatcgttggcgtagtgtaacttcaagtggtgtaccttgttcgtgctcgtcttaaagcttaagtctaaagttttcatgggcgtttcctcctattattatgggcgtgttaggcgacgggttgtggatcgtagcggtaggcgttggccaagttagcggccgtgaactggtcgcccgtcaagacttcgacgactttaccaaaagcggcgagttgttcgtcagtcgcgtcttgggcgatggcggtgaaggtttgcttacgttgttcgtccaattccgtagttgtttgaacagtcagggttgcttttaaccaagttttagtcatgatgagttcctcctcgaattttgtggtggtaggctggccagcttacattaatacagacggttgagcctgacgatttgtgcagtctttgccaaaactttttttgcctagggtcgatttatgccgccgactcggtgacggtgcggacggtaatactgatacgtttttcggcaaatagtggggtcaggatagcaatcagcgtggcaaggtcggtgtcggtcagttcgtgtccagctgaccagcgttgacgcgagcagtgctgcttagcgtcgatcactgtgagtagcaggtgggtgttcatccaaatatgcatggtcgcttcctttcagacttcgacagtcttatgattcgtatttgtcactagcttgttgctggtagagctggtgggccttaacgagtaggctggcccgccaattatagaccgttcggcggctgacctggtggcgccgcatgatgctggcaacggattgttcttcgaggaagaattcggtgagataaatgcgttcacctggtcgacattgaacgaggaggtcggttaagaggtcggttaattgccaatgggtctcctgttcggtcatggggtcaatggcgatgggcagagcatgcaccaagttgacttgcgactgggtacgcaaagtttgcttacgtaaatagtcgacggtccgccacttgatccgccgaaatgcaaatttacgaaaatccagcaagtttgcaggtagttcgggtgcatagttctggtaggcggacagccaagtcaagtgcgccacggtgacacaatcctcaaattgtggatggtacttagtgacttgggcggcttttaaagcgccgtacagtaggcgttggtgctcgggtcgagcgagtaaatcgaaagcaacttgattatcaaaacgatcagcgtgcatctgaataaccccatttatgaatgatttccttggccaaggttgatgctagtgtagcgagcagtcgctgatgctgccgggtgtgaaaatagcttgaaaagtgacgatttattttcattattaatgttccaatgagatttggtcaaattgcggaccaactactttcctagattgtacgtaattgttatgatgtgattaatctaaaataaccgcggacagcgggggctcggctggtgaatgttagagagaaatacctattttgagggggctttaccatctatgaaccaaaatattgacggtccacatcacgttaacactttttggcagtgccatgccggtacttgggacacccgacagccacaacgattattagcaattgcgcaacgcgctgaatttgcaacaatcgacgtgctggagacactttttctacttgacataaaacacctaacatgcgtagagaatacgctcatctttgatcgccaacgagggctgatcaagacgaaactgacgacgcgccagatcatggtggcgtatgctggacgcttgggattatctgggacacagctgattaagcaactcgctggcgagatcgggttatcgaagcacaagttacccgtgattcatggcgaggcgatcctgatgccactaaccaccgccaagcggggaacgaccagttggtataatcggcattatttgcaccatattgaggctcaaggtttcatgacggctttggtttatgatgggcagatcatgatccaagtggacatgagtgagcgggtggcgacccgtcaacttgagaaggctggtcaactgcaagcggcactgcaggaacatcatcaccggcgattagtgcctgatcaatcggtgcctccgatggcagatacggatcacgaaatgatgcagtcgtatactgaccaagtcctgaagcattttgatatcttagcgcttcccggagaaattagttgtttgacccgtcaatttttcggtaaactataggagtaacgattaaaagatgggagttggtgtcgttgaccaaaaaaatcacgaagattgtcgcccaaaaacgagctggacgctataacatctacttagacgagcagtatgcttttccaatcagtgagtcggtgatgatcaaattccgcgttttcaaaggcatggaggttgatgaacaactacagacggcgatgattgcggctgatgatgtctccaaggcgtatacgcgcgcgcttgattatctctcacaccagttgcggactgaaaaagaagttcatgacaagttacgggatgaagagattgatgaggcggtcatcgacgccacgatgcaacagttacgcgaattgcggttactgaacgaccaacagtacgcggatgccttcgtgcggacggccaaacgcactagtgataaggggccgcgggtaattcggcagaacttacggcaaaagggtgtgggtgagcagctgattgatgatgctttggctggccagttcagtatcgaagaacaggtcgataacgccactgaactcgcacgtaaattagcgaaacgctatcaccggcaagcttttaagacgatgcaacagaaagttcgtcaaggtatgatgaccaaggggtttgataacgatacgattacggccgcgattgcaagtttggcactagcacccgatgaagatgaacagtgggaagcccttgtgacgcagggggcgaagctgtggcaacgtaatcgcaagtatgcctttcgcgaacgcacgatgcgtacgaaacggagcctgtttcagaagggcttcatgatggacgatatcaatcgatttatcgacgaacaagtcgctgatgagtgaaaaggttgaattacctgcccgcacgccataaaaatctggtataatgtttaatgaaattcgatgaaaatttaccctcagtttagaaagttgggttaatatggcgcgcgaggctaaaggacctaaggaaggcgacttcattacgatcaaaagctataagcacgacggaagtttacatcgaacttggcgcgatacaatggtactcaaaacaagcgagaacgtactaattggttgtaacgatcacacactagttaccgaggatgatggtcgccggtgggtgacgcgggaacctgcaatcgtttattttcataagcattattggtttaatatcgtggcgatgattcgcgataacggcgtttcatactattgcaacttagcatcaccatacgtgttagataaagaggctttgaagtacatcgactatgatctggatgtcaaagtctttcccgatggtgaacggcggttgttggatgttgatgagtacgaagaacacggtgcccaatggcgttattcggctgatactgatcgcattttaaaagcaaatgtgaaagtcttagttgattggatcaaaaacaaaaaaggcccgttttcacaagactacatcgatatctggtatagtcgctatcaagaattatcacgtcggcaatagctctgctgacggtctgtcagcggcgtaattaaagtacaaagggagcgactccgtgctggggtgctcccttttgtatcttcgccgtcatgtggagttggctcattcaacgtgataaccgaccgtcatggttgacacgggtcacgataattaggacaataaaaaacgacccacaagacgggtttgcgagtcgtttgaaaattgaaaatcacgatttatctaagcgccaaagttgactggtcgcgaatagccgaccgcgtgccaccatggaacgtagactttttcattcttaacaccgttgtcttgggcgtcgatcatcttgccaccaccaacgtaaatgccaacgtgtgaaatcgatcccgtgccactgccaaagaagactaagtcacctttttgggcgcgttgtttggaaatctttggatattgtcggtactgggcttgggccacacggggcagggacttctgcgcggcttgctggaagacgtacttggtgtaaccggaacagtcgaacgtgttcggaccgaccgcaccatagacatagcggtgaccgagtttggatttggccacgttatagaggttggtgaaagatctggtgctcttcttaagggagccggtcttgacccagccacggacacggttattggcactggttataaaataataattggccgtagtattgttggctaagcggacttgccgttgttggctgacaaaccaagtggtattgccatattgccgaagcgttccgcgatacttgattttaagattagtagtggcaccgctcatgttatagaagccgccctgcatatttttcgtcaagtaagcagtcctggtcagatgagtggttctaatgacgcgattagttgagctggcgtcgacgtttggtgcttgccaaagccccaccgcgaggcctagaatagcaacaatcagtgcgataagccgttgtttcatatgtatttcctccccgaaaatccccgtgtccatctcattcattaacgctgaccctatcataagcgctgattgtaacaaagttgttgcaaatgggttgcggttcgattaagtaatatcgacagcttgagtggattaacaataactgattagatcttgagcgataggagtgatgaacttggcttttttgaagattgataatggtgaattacttaagaatattcggcagtttgccaagaagaatggactgaccttagcggaagtggcgaccttagcgggattgagtgcgagtgccatctatagttggaagaagcacacgccgtctgtcgggacgttgaaagaagttgcccaggtactcggtacgagttataccaaattagttggtaaggataaagaaccgaccgccaagtctagcaatgccgcagctgtcgacctaaaaaaagtgattgaaaacaagaaaaaccagtttgaatatgacggccaaccgattactaatgagcaaatgaaaattatcagaaacgtcttgaaatcgatgtttaagaccccgcgactttaattttatgtaaaactcggttcttttaggtgcaactaggacctgcttagtgtaaaatattgctcagttacttgaataattgctagcagcgcttgacgggtttgaatgaatggtgcacaatggcaacaattatggaacggattgggagatgggcgtatgaaaaaagttactaccgcattagcaaaaaagaatatcaaccagttgttaacgattgttaatcaaggccacgataccattgaggtggaaaatcccagcacccaagattcagcggtaatggttagtatgaaggactggttgcagattgtcagtcaattagccaaaatgaatcatcatgatatggaattcagttaaataataataacgaactaattgtgccagttaaggctcacttagtccgataagctaaaggcaccaccgacataatcatgccggtggtgcctttttgaaagtcgttgtacttataatagtgcggattgcgccaagatctgttcaatttggacgccgactgtgttcatggtcgaccattttgcctggttagcaaagaagaccatggcaaccttgctgtcattggaaccgatgtagagactatagagactgttgtcagcaccaccaatgcgaatcgtctcatcatcacggtagtagattccgcctgagtaggttggttgtaagttagcggccagttcttggaatcccgctggcgtgagtagttgcccatcgacgagatgatgaatgaaggtgtagaagtcgccgacactggcgtaaaggttgccacaaccgagctcactggatagtaagttggtcgagattgaccggagagttgcggttcctttactgaaggtgtaggggagcggatgaacggcgttgactggcacttggttataaacaaaggtgtgctgcatattgagtggctgcaaaatatcagcctcgaggttagcactgaatgattggcccgttaactggtcaacgataccggctaagagggtgaagttggcgttggaatacgaccactggtgctggttggtagacgtcaagtgctgcagggtgaagtcgacagcctgttgatcagtagtcaaagcctggtctgggacgggttcgcccatctgaattcctgaggtgtggtcgagtaattggcgaatcgtaatagactgcgcataggggacttgcgggtaaaagtgagccagagttgtgttcattgtcaattttccggcattgatcaggtgctgaataactgcaccagtcactgacttttctagcgaggcgagcgggtacgcttcgtcaacggtattggcaaggtgttgttgcaaattagccgagccaaaggtcaaagttttgactcctgctggtccattattcgtcaggagcagggtccccatgaaatggttagtggtcatgagctggttgatggtttgtaatgcctgttgggccgtgtatttcgtgaccggggcggtattgactgacgtcgcagcggccgcacccgttgctgtcgacgagctcgatgacgcggttgcggccgcttgtgatgcggtcgctgacatcgtggtgtgctcggccagtcgtgcggcagcaacctgactagcgctggacgttccagttgaagttgctgtgctggacgtccgagctgtaaccgtcgctgatgtagcggctgacatcgtggtgtgactagccggttgtgcggcgctgttctgactaacaacggacgttccagttgtgccagttgtttcagttgaggccggcgtcttcgatgacgtggtaaccgcttgtggtatggccgcggatgtcacagttttgtggtcagtttgtgcggaagtagcctgactaaccagtgacgacgcgctgtttgcattggtcctaattggcacctgactgaccgggttgacgtgactactaggctgacttgctggtcgtgtcgcggttgcaatctggtcggggtgcgcctgctgatgcctaatcaccgtcccagctgaggttaccggttgagttgtggtggctgtggaagcgacatccgccgtggtagctcccgaactgactggcgcttgatgagttggtgccgtggcaacactggaatggaactgaaccggcgcgtgtggtgcggctatcgctggtcgttgaacggtttgctgattgttgaactgggccggtgaagtggatttctggttcggtggggtagccggtgttgatgcattcacatgttgtagttgtccgactgagctgttggggtgcgctggtgtcgcgttgttctcggcgtgccggaatttaacggtgttaagattctgaggttgtcccgtagttgccgggccggacttgggtgttgtcaggccagtctgactatggatgggcgtgactgctcgggtgggggtagtcaaatgtttattttggagaggtgtagtcaatgtgaatcgtagtggcttattgccgattggaacccagacatgccagcctcgtggtccgacgatttggatgtattgcccacgcgttgtccggaccggtttgttcacgcgtagatgaagttgattcatttgatgcgtgcttaattgatgcgtcatgatcagttgcagctgccggttagttatcattggcggtgtcgtggtgtgggtgctcaatcttgcagcgcggatggcgggcgtcttaaagcgttgtcctgtcggatgcttagcgagcggtatcaaggtgcgtgcagcaacccaaccattaaaacggttgctgatgatgtgaaagtaagtgccaccaagaccgcgatgttgctgaatgattttgaaagcgatggtcatgggttggcgggtgaagtgaccgcgtcgaagttggcgccgattggttggtagttgtggataaatcgtgatcccgtggctggtacgcagacgagagtcagttggtttagttgcggcagtggctggttgaacaagtgtcaggttgctgaggctgatcaaggtcagcatggtggttgcggacaagcgttgtttgaacgtcaaagcaattcccccttttagctgctcattaatataaaacggtggcccgacaattgcacggcttttcgaatcgacgttaaacttcctaacgtgttttgataagatacggtgttttttaagttaacgttgtttgacagagtggacgaataaaaaccggctaacacgttggatacgtgttaaccggttagcatgatgattgttagttcgttgactttggcgtgctgattagtcggtctgactttcagcgtacttggtcttgatataatcagctgaaacttgtaattttttcaattcttcgtccgtgagatccaattgaacctgttcgacgatcccgtcacgaccaacgacggctggatatgagaggtacacgccgtattcttcgcgaaagttggaaacggggagttcggtgagcgcgtcattcaagaccgtgttggctaagcgcaccgcggccgttgcaacaccgtaactcgtatactttttaccgtggaagacccggaagccgccatcgcgtgattcagcgtctagtttagccagatctaaaccgcggtcggcggctaatttggtaattggttggcctaacactcggaccgttgaccaagccgtaaattgagaattgccgtgttcacccaggttgtagccggccacggaccgtgagtccaggttgagggcactggcgacggcccgcttcatccgtgcggagtccagcaacgttcccgtcccaatcacgtgattctttggtaagccagtaacggcctgatagattgaggtgatgacgtccacagggttggtgatgacaacgaggatcccattgaacccactagccttgatcttagcagcgacatccttgacttgcgtgctggtaaacggcaattcgaggaagcggtcgttagttggtgaatcttgtaacttaatattcccgatagctgagataatcacatcagcgtcaatgagactactgtagtcattgacaataatatttgtgtggaagggtaagttaggcatggcgtcttgaaaatcaagcgcgtccgcttcgaccttgctattattcgtatcaatgagaaccaggtcgtcagcaaagccgttggcgacgatgtagtgggcagcggttgaaccaacgtggcccattccgatgatggcaattttacgtgacataagatagcgctcctttaaaagtttatcgttcattaattaaattaccatgattctcattgattttaaatagattttgtgagaaatatcgaaatcgtattcgggctaagtgaaatagggtataattaacgcattactagttgcaccaagaaagggaggagcgcgagtgtttaagcgcctaaaagattcggccttattatattggtcacttgagattttaattgtggcgaccttgatctgggtctgcacgaacatcggctttttgtttcagcccatcggcacgtttttaagtgtcgtgttcatgccaattttaatttcaggatttttattttatatgttaaaccccttggtcaagttattgacgaaggttcattacaagaagtttcggatttcacgaactggcgccgtggccatcgtatttgtgctattattcggattactggtgtggggagccgtttccctgttgccgcggttagtcagtcaggtaacacaactgatctacaatttgccaactattgcgacagagatgcaaaaagctgctactaagctgatcaataatagttcggtactgaaaaagatcgacatcagctcgtataccaagcagtttaatggcgaaatcagcaagtattcgcagaactttttgtcatcattatcaagtagtgtcgtcacggtgatctcgacgattacgagtgtgaccatcatggcaatcacgattccggtcgtgttgttctatatgctgaaggatagtgagaagttcattccagccatcagtcggttcttaccgaagaaacagcgcccagaagtcatcggcttacttcagaagatgggcgacacgatttccagctatattagtggtcaggttatcgagtgtctattcgtggggacgtttacggcaatcggctacatgttgatctcgcagccatatggcttgttgcttggtgtgattgccgggttgacgaacattattccgtacgtggggccttacattggaatcgcaccatcgctcatcgtggctttcaccaagtcaccgatgcaggtggtgtacgtgattatcgtggtcgtgattgttcaacaggttgatgggaacttaatctatccgaacattattggtcggacactcaagattcacccgttaacgatcattattttattactggcagccggcaacattgctgggatccttggcatgattttagcgattccgttttatgccgtggtccggaccgtggtgatttacctctataatattgtcgagttacgaaatgaggagcacttacgcaagcaaacgacggtctaccagccgcaacctgctaaggcgactaaagtagacttgacgacgaatgctaaatcaaaaaagtaggctttactttaatacccggattgaacccgaacgcgctcgccgatggccgtgtttgaacaggtaatgggggcgtcaagccgttgcaccaaggtcatatttggtcgttaagcgtgtatttggcaaattagcggatattattaaagatagaaacaccgtcgttacgcataacttcatgctgcgtaacgacggtgttttgtttaacggttgttgatcgagtgaaatttcagtggcttggcaactggaataggtatacaagttactataactattcagctagttcgagaagcttaatggaagatagcgttgagcgccagcacgcctccgagaccgcagacagcgatgatcgtttctaacatcgtccatgtaagcagcgtttgcttgacggtcaggtcgaagtattcccggaacatccagaaaccagcgtcgttcacgtgagaagcggcgacactcccagagccgatggcaattaccatcagggcggggtcgataccagcttgcgtcattaacggcgcaactaggccggctgccgtgagggccgctacggtagcggagccgagtgagacccgtaagatgacagcgactagccagccaagaatcagtggtgagatgctgctgccactgaacaactgggccacggccttaccaacacccccatcaattaagatctgtttgaaggcgccacccccaccgatgattagtaataacatggcaattgacttagtggcatcttcgatggtggccgtgatggccttattggtcttgtgttggtgaatccccattgaccagagggcgaataatagtgaaattaacatggcaattccgggtgccccaatcaaacgaatgatttggtcaagggttgacgggcttttaggtgtcacaccgtgatcaacgaccaattcgtagacggtggtaattgtcatcagaatcacggggaagagcgccgttaagacactgagtccaaacccgggtgcttcagatactttgaattgacgtttgttactgctaagtggcaggtgtggtttaccggtgaatgcgtcaggaaccatcttttgcgcccagcgtgaaaagagcgggcctgcgatataaacagttggaatcgcaataatgatcccgaatagtagcacatgacccacgttcgcatttagcgtcgtcgcaattgcagttggtgccgggtgcggtggtaagaacccgtgagtgacagataatgcggcgcccatgggaatcccgagatagagaacgggaacttgtgcttcgatcgcaatggcaaagacgattggaatcaacaggacgatcccaacttcgaagaagagggcaatcccgatgataaatgaggcgacgacaatggcaatttggagtcgtttgcgtccgaaaatatccaatagtgtcgtggaaatcgtataagcaccaccagcatcggctactaagcggccgagcatggcaccgaagccgaagactagtgctaactcaccaagttgcccaccaatcccgttttgaatactagtggcaatcttagttaatggcattccgagtccgattccgacaacgacggccgtaacgatcagcgcaatgtaggtattcagcttgaatttaataattaataataacagtagtaggatgccgagtgtaagaacaacaaatggcatagtggacactcctaacgatttagagtagcgatttcatgatataacggggccaattgcgccgttacgtggtcaaagacgacttggtgctgatgatataactggtggttggcggcgttgggttgatacgtctcagtcgcaccaatcatggcgtgaatcgcggttaagtcatcaatatgtcccagtgccttgagaccgataacggccgctgctagacaggaactttcgaagcttgctggaatcgtaatgggttggcccaagacgtcggtcaaaatttgccgccataaacttgaacgggcaaagccgccagtggcccgaatcgcatgaactggttcggcggccgccgtcaattgtaggacggtgttcaggttcatcacgataccttccaagaccgcacgcgcaatatcagccttggtcgtggtcgtggtgacgcccagcagtgaaccgcgggcatccgcgttccagagcggcgcgcgttcaccacttaagtaggggtgaaataagagcccgtgggcgccgacaggaacggttgcggcaagcgctgtcaattggtcgtatggatcttgctgattcgcgcgagcggtttggctttcagtcgtgaagagctcatcacggacccaccggaagacttgaccaccgttattgattggcccaccaacgatccagtgatgcggcgcgacgtagtaacagaatagtcggccttcaggatccaagtagggttgtttggtcatcacccgtacggcaccggaagtaccgatggtaatggcagcaacacctggttcatcagccccgacgcccaagttggagagggccccgtcactggcacccatgataattttcgtggtcggcaggaggccaaggtcgttggccgcggccgttgtcaggccgtcaatcacggcgtcggtatcgaccaatggtggtagctgcgtgcgggtgatgtgcgcatagtcgagcgcgactggttcccaatcaaaattgtaaagattgaataggccagtggcgttggccattgaataatccatttgaagttggcccgtcattttgtaaatcaggtattctttgattccgaccacgtgacaggtttgtgctagtaattccggtgaatgatgggtaagccagtgaagcttaaccaggggactcatcgggtgaatcggtgttcccgtgaggtgatatagtcgatcacccaggggttgacttttcaattcagcggcgtcttgtgcggcccggttatctgcccaagtgatgacccgggtcagcggttgtttctgactgtcaagtaggatcaagctgtgcatggcggatgaaaaggcgattccttcgatatcttcaggatcaataccagcactcacctgatggatggtcgcttgaacggcctgccagatttcttgcgggtcctcttcggccgtggtaacggtatcgtgatagagtgggtagccaacgttggcacttgcaattacgtgaccctggtggtcgtacaagacggatttggtacttgtcgttcctaaatcagttccaataaggtaagtcatggtgcttcgttcctcctattcgtgatcgacagcgtggccaccaaactcgttacgcagggcggcaacaactttaccagtgaatgtgtcatcggtttctgaacggtagcgcatcatcaaggccatcgcaatgaccggggtggcgacttgttggtcgagggccgtatctaaggtccagcgaccttcaccggatgaatgcatcacacccttgatgtcgtctagattaccatccttgctgaatgcatcttgagctaagcccattaaccagcttcgaatgactgagccgttattccacattttggcgacggccgcgttgtcgtaagtgaactgactatgctgtaaaacgtcaaagccttcacctattgctgccatcataccatactcaattccgttgtggaccatcttcaggtaatgaccactgccaacagggccggtgtacaaatacccatcgggagcggcaatcgctttaaatagtggttcgacgacttggaaagtggcggggtcgccaccaatcataaagttgccattgtggcgtgcaccggcttgaccgcctgacgtcccgacgtctaagaagttgatgtggtgacttgccagcaattcgccgtggcggatactatcttgatagtgcgaattaccaccatcgaggacgatatcacccgcacttaaggtctgggctaactggtcgataacactgttggtcgcctgaccagcgggtaccatgatccacacgatccgtggggttggtaactgctcaatcaaattggtgagatccggggccgtcgccaacccgttggcactggcggtgctgagattggtggggttgagatccgtccccaccggcgtgtgcccgttgtcttgcatgttcaacgctaagttcatacccattttacctaagccaatcaatcctaatttcatgatgaaacccctcttttatatgaaaattattaagtattttttgtattcgcttacattgtaataaaactatttacataaatcaaccgtatatttgtaaattattttcacaaagctgaaaataatggcaaccaagcccggttttacgggcctgattgccaagaaaaaatttgttaaattgctgaccaaacggctgcaccgatacttgggaagagggtcacgagttgttcacgttgcgccggggtcaattgatattggatcgctggtagtagcgtgttaatggtattttcggcctgttcaccgagttcagcggcaccaatcaaccgttgctggtcatcggtcacgagtaagttatggccagtgacatcgcgcgttgtctgccggaaccagtcatcctttaaatcattgacggtaactttgatatcatgagtgtcactggttggaagtgtaccaacttgggccaatcgtggggacgtgaagacgaccgatggaatggccggatacttgatgggggcattggtgtcacccatgaataggtgggtcaggtattgcgactcaaagatagcagtgggtgttaattttggttgatccttggcgagaacgtcaccggatgcgtagatgccagcgacactcgtttgcaagtggtcatcgacggtgattcccgctgctgtgtagtccacaccgattttttcaagtcctaagtttgcggtgttgggctggcggcccgtcgcatctaagatccagtccgttgtaaccttgtcatccgcactgaggacttcgaagtggtcaccagtcgacttgatcgcagttggcacccattcacgttttaggactaaaccttgttccacgagaatggccaataatcgttcaacgaatggttggtggaattgacgaagcgcttgatcaccacgcatgagtagggtgacctgactgccggctgtcagtgccatgttggcgaattcgagtccgatgtagccggcaccaatcacggtgatgtggtgtggcaaagtggttagattcaaaaagtcgttactgtcatgggcgagttcggtgccgggaatgtccaaacgatgtggatgctgacctgttgcgatgacaattttatcggcggtgtacgtcttgtccgccacctgaatcgtatggtcgtcgacgaacgttccgcggccattgatgagggtcacgccggcactagtcattaagccagcaatcatatctggtaagccggcgatgacgtcgcgttcgtggtcgaagttggcttgccaatcaatcgtcggttcaccacgcagaccgtatccttggaagttagcaacttgattttttaatgctaccggctggtctaaggtgattttagcgttgcaaccccgattaggacaggtaccaccaatcaaatcagcttcaatgacggctacttttttgccacgagccgctaacggaatggccccgtcaaacgttccgtgaccgctacctagatatacaacgtcaaatttttctgacatattaaaatcctcctcgttcccaaatcacagttatttaaaaacaaatacattgtacacaactcaatttaacatgccaaataaaacgcggccttaatttaaaagtatggccctgaaatcgattgcaactggtctgtcatgactttgttaagtgaattcccaccgaatcggtgcaagatagtcagtggtactggattttttggtcaaatatcagtaaaatatgtaaggctatgtttttttacggtgggacggtaccaccgtgcacgttgaatatacaggttatgatgaaaggaatttttaatgaataagacagaattaaccgccgcggtcaatacccggcgtacctttgcgattatttctcacccggatgccgggaaaaccaccattacggaacaaatgttattgtttggtggcgttgttcgtcaggccggaacggttaaagcccgtaaaagtgggaactttgccaagtctgactggatggaaattgaaaagaagcggggaatctcagtaacgagttccgtgatgcaattcgattacgatggcaaacggatcaacatcttggacacgcccggacatgaggatttctcggaagacacttatcggactttgatggcggtcgattccgctgtcatggtcattgactcggctaaggggatcgaaccacaaacgaagaagttattccaaatttgtaagatgcggggcattccgatctttacgttcatgaacaagttggaccgtgatggtcgcgaaccattggacttgttgaacgaagtcgaagaagtcctcggaatcgaaacttatccaatgaactggccaatgggtatgggtaagggcttaaagggcttatacgatcgttacaatcaccgtgtggaactttatcataatgaagctcatggcgaaacgttcttaccactagacgagaacggtgagcttgatcctagtaatgaattgaccaaggacagtatttatcgtgacacgttggatgaagtcgaattgatcaacgaagctggtaatgattttgacgaagctaaagtaatggcgggagacatgacgccagtattttttgggtctgccctcaccaatttcggggtcgaaacgttcttgaagacgtatctgcagtatgcgcctaaacccgctgctcataagactcgtgatgaccaagtcgttcagccaaccgacgatgaatttgccggttttgtgttcaagatccaagccaacatgaacccgaaccatcgtgaccggatcgcctttgtccgcatttgttctggcgaatttgaccgggggatggacgtggtcttgcagcggactggtaagaagatgcgcttaaacaactctacgcaattcatggccgatacccgtgaaacggtggaaactgctgttgctggcgatatcgtcggcctctacgacacgggtaacttccaaattggcgatacgatttacgctggcaaaaatgcggttcaattcgaaaagttaccgcaatttacgccggagctcttcatgcgcgttacagccaagaacgtcatgaaacagaagtccttccataaaggtattgaacaactggttcaagaaggtgccgttcagttgtacacttcatattcaacgggtgactatattctcggtgcagtcggtcaacttcaatttgaagtcttcaaattccggatgcaaaatgaatataattcggaagttgtcatggaaccaatgggtagcaagactgcccgctggatcgatcccgaacaattggatgaaaagatgtctagttcgcggaacctactagtcaaggaccgttacggggcaccgctcttcttattcgaaaatgcttttgccgaacgctggtttgcggataagtatccggatgtcaagctgacctcgaagctctagaatttatatttttggttacacttagttagattactgttcgtcagccaatgttcgtcctattccgacctccggggctgggtgacaattgctggaacgtaagccgacatcgatttgagctaacgcacaatccacggccacttaacttggtgcaattggtcgctaactattttgatactggaactttgaataaaacatcagggtgcataaacgactttgtcgcacattcaattttgaccacagcggcttaagatagtgagctattccaatatcattttcagtctgatagttgcttagcaaaattaccgtttatgaaaggcaacgacaaattcatcaaaagttaggtacatcttcgtctgctattcgaatactatcccgactggaaggcgtttctgccaatgctcagcggtgaaattccacttagcaagcgtctttggcttggttagtggaagaccagtatttaagacgtggtcttcggcttaaatctgtgtccaccgcgttccagcaattggcagaaatgcctggaggtcggtgtaggacgcacctaccaaaaaagtttacgctaacccgaactgtttccagcgggcctaagccggctgcccttgatttaacggatagaagtaaaagcacaaacaaatatgtgaataattcataaaatgatgggactgccaagttgatttggcggtgtcatcattttttgtaagtggcaccggatagaagtgagatgaacggttcttctgacatgctgattggtccatgtaaattcaccatgtaaaccaacgttgcagtactgctaaggtgggagaattacgatacaatcaacctgcaatttagattgtagggggcgatgagattgaaaataaagggacgctggatgctgggattgatgttaggaatggggttgtgggggccagtgacggtgcacgcggcgacaaatttggtacggtggccagcggtgcaaagtttagcgccccggaattgtgaacttgaatcgcaacaaacgcgcttatatcaattaaatcgtgcaacgatgcaattaacgccacgtgggacggcccggacgactagtcactggcaacgggttggtcaggtgatggtgacacaaaacaagcggttagtgacttattggcaggtgcgtcacgggactgctgggcgactgagctgggcgttggcggacatcgtacgagttgtcggaaccagggtcactgatattaagacacccacgcggcaaccgatgcgcgtggtgacaacggatcaacaggaacatggggtgacgcgcgcggccaataagctgagttatttgcccttaaaaggagcgggacgttacaccactgcgcatattttgtttcgtcctaccgcggcgtatctggcgactcaggggttacaaaatcagccagatacgttgcgccagagtagcggctattacgaccattatcatttcaaaacggcactgtatttgccgcaacagttaggggggcgcttgttgaatgacccacagagtgcgacgttttcggcggacaatcggtacctgtacgtcatgtatgtcaatgatcaacagccaggtggtgccgaccagacgggctgggttgttcgctatgattggcaacgcctgatggctttaggggctgggcaatcagggaagatggcgatggtccgagtagcagcagctcaccaattcgacggtaagatgacggcttttgaccggcgggtgctggccgccattgaagtggggccggagtttacggcgggacacgttcagtcactagctttaaatcctaagacaaacgagctgtggtttatttcatcgacggcccgtgatcagcttgcaagtgttgcgcgactaaatccgcaatccctgacgccggatcttaaaattgcctttactactggtagcgggcgtctaggtgatgaactgacttttgatcgcgctgggcaggcctattattggacgcatgcgagtcagctcagaaatggcaatgtcacgctttatcgtggcacaatcagttcgacgactggtgtacattttgaacaactcgcgcaggggttagctaataatccggggttcttcgctcaatcgattggatataacgaggttactggtcggctctacctggtctccgatgagagtattacgtcacttccagcggctaaactgggacacttgacgactagtcaggtcggtgaggcgaactttgctggtgatcgcgagtttgaagggttagtcttcatgcaccacagccaggaaggtttcttgctgacgaatcggggcatcgagttgatgcgcataattgttgataagtagatattaaaatgcaccactcgctagattagattgaagctagcgagtggcgcattttagcatggttcgcgttaatcgaacaaaagtcttgtttaagcaaacggtggatctaatttcgttaaataacggcccggcaagtaaccttgatcttgcaggcgataccagacgaccccgttgtcgtcggccattcgctcaatcaaattgaccgtgtcaccatgagtgacggtagttaaatagcggccatatggttcgatgtatgtgtggacctgtttgccagggacaaaactgacgacgccggtttggcgaacaggccgtttattttggacgcggtagccggctggcaacttgagtaacagtgtgtcaccggtagttaattggaggtgcgtctccggaatccactgatcatcgccaatcgcataccaggtctcgtgggtgactaagcgaacgcgcatgtacgttttataagtgctaccgggctggagcttagttaaatagttggtcgtagttgccccaggatacggataaacggcggtcaacttgttgacttggacaaaaccagtactgaggtcagtttgctgccaattttgattgcggtagaaaaaaaggaccgtcttggaagtggtcgtgtattccccagtcacgtcgcctacggaacggaggagcttaaaaccggcgacggtcggcgcactgacttcgtaaggggttcctaatttcccccggtacatggtcggccggccaattagttcgcggcggtcaatgtcataggcgtacatccagactggttggccagcttggcgttcgtaagtcaacgtgatgctagcctgtggggtcgtaaaccagcgagtcaagccttcgatatggacgaggtggtagccggtgatgctgacggctggcaagtgaatctcttcgccaatggtgccagcaatcatatcagcagcctgcagttcattgccatcctgatctaggtggtgaacgagaactaatgcttctgtttggttaactgtaggtgctgcggcagtttgtgcggcaatggaacgtggtgcctcagtagcgcttgtggcggcttccgtgctgtttagtgcctgaagcattcctttaagtcggtcaagaaacgacacgtgaccactcctttcattaataaattaattatcactagtataacgcattcacaagggttctggcacgtcttaaataaattgtaaaattcccgctttgtcagtcgtgtatactaatatttaataacagggggcgttaacggatgaatctaaaacaattacaatattttttggccgtggcagaggaaggtcagatgacagcggccgccaaacgcttgcacgtggcgcagccaccactgagctatcagattaagcaattggaacttgaactaggcgtcaccctcttcaatcgcttgcctcagggtgtgactgttactgaagctggcaagctactggtggggtatgcccaacagctcacgcagttgtcggcgactgcggagaacaaggtccgggccctggcacacggcgtgacggggaccattaatctggggacagtttcatcctcggcaggggtcatgccgaatacggcattactaaagtggttagggcaacatcccgatgttcagcttgcgattacggaaggcaatacgtatgagttgttagacgatctgcataaacggttgctagacgtggcggtgttacgaacaccgttcaacgcgcaacatctagtctgtcgttactttcccgcagaacggatggcagcagtcattccaaagcgatattcacagtttgaaaagcggcgccagttgcgactaagtgacctcgctacgttaccattgattaagtaccgtcgttttaatgaattattccacgttgcctttctggaagcatcggttacgccgacttatatcatgacttgtgatgatgcccgcacggcgatgcactgggcgaatcatcaattaggagtgaccctggtgccgcggtcattggcggaaacctatgacggtggtgacgtgatgattcgctcgttggcggatcatcgcttccagacccaactggccctagcaacgacccaggaagccctagcgactccattagttgccggtttgatggcccaattccagcaagcgcggtcgctagactagtttaatcagtttgatatctaaaaatttaatcgcagttaagggtggattgctgatttaatcgggttgttaccgattacactagctagaaattgaagtggtgttttcagacgcaaaataagcctaatgactgtcgtactggggatacgctaaccttcatttaataattagatatcaatcggtttaaatggtacactaacaattgaaatttgaagggtgaaggtgaaggaaatgatttattcgttagggctaatgctcggcgttggggtaattgccggaattttcggtgctattttaggtatcggtggtggcatgatcgtcacaccaatcctgacacttggtttgggattagatattaagtatgcgattggggccagtattatcgccgtgattgccacgagttcgggctctaccattgcatatttacgtgatgagatgttgaacttacgcgtcgcgatgtttcttgaaattgcgacgacggtcggggccgtcctcggggcagtgttgacgggggtgcttaatgcaacattcctgtacttcctatttggggcgctgttagttttcacgacgtataatatgattcgtaaattaatgagtaagaacggtgaattaccgtcagtcaaagatgacaagctggcgacacagttgaacttaaatggtacttattatgataaagcattgaataagcaagttgattatcaggttgaaaacgtaccgggtggtttttccatgatgttcggtgctggtttcgccagtggcttgttggggatcgggagtggcgcgttcaaagtgctagccatggatacgattatgcatatgccgcttaaaccgtcatcagcaacttctaacctgatgatgggggtgacggcggcagcgagtgcgatggtctacttctttaatgggtcaattaaacccggaatcgcggccccattagctatcgggattatcgtcggtgccttaatcggctcacgaatcatgacgcggctcaagccacgcttgattcgcatgatctttgtgcccgtgatgctctatctgggaattcaaatgattgctaaaggattcggggtgaccatctaatggataagcaaaaaacaactaaagcgcaagagatgcacgctgttgaaatgatgattgggtatattctacgaattggcgtcattgtttctgcaatcgtgattattattgggatgcttctgatgttgattcagggcaatggtggttatgcaaatggtatggaaccccatacggtcgctgatattctagctggcattgtggcacttaaaccatatgccgtgattatgttaggtttatttctattgattttaacgccaactttgcgggttgcggtctctatctacgcctttgcagtggaaaaagaccacttatatgtttggattacgacgattgttctcatcatcttgattgttgcttcggtgattgggtatctcggtaactaggctagacggagctgattaatcaggttgagtcgtgattaaaatgggcgcacatctaaaatggctaccagcttgtttcgaggttaatgtggaaagaatctaagctggtataaattcacgggctggtgtgttttatgccgatgtacgagtacttaactaaccaatattgtttgataataagagaatgctgataaaaaatcagcattcttttttatttgtgcacttttagctgttttgactaacgtaaaaaagacctaatatcgtcatttttattgttatttgaattatttattaagaaaaattgccgattgtgttcacttgataattgaacactggtgtgagaatataattgctgatatatcagtaatttcaggcatgtttatcagtatggataataatcgcaaaatgaaataattaagacgattatgacgaaataatgataaaaattagagtttaggattgattttaatttatttataatatacaattactttaacttttcgagggaaaagcacacacaaactattttaaagttaggggttgggttatatgaatttcaaaacagctgcaaaagtaaccgtcgttgccggcgcatccgtactattcttagctgcttgtggctcaagcaagagttcttcaagttctaagcaaacggccaattggaccgaatcagccgaattaccaacgatggacatttctaagtccaccgatgtggttagttctaacgcgttgaataacactaatgaagggttataccgtctcggtaagaacgggaaggtcacacccggaattgcgaaatccactaaggttactaatggtgggaagacatatacgttcactttacggaagaacgcaaaatggagtaacggggataaagttactgccaaagactttgtttatggttggcaacggaccgttaatccaaagactgcgtcacaatacgcatacttatattcagggattaagaacgctgacgctatcgtcaatggcaagaagcccgtttctagtttagggatcaaggctgatggcgattacaagttgacggtcacgttggataagccaattgcttactttgacaagctgatgggctttgttaacttcttcccacaaaatgagaaagtggttaagaagtacggttctaagtatgggacgagcagtaaggccatggtttataacggtccttacaagatgactggttggactgggacaaacttgtcatggaccttgaagaagaataacgattattgggataagaaagctgttaagatggacagcatcaagtaccaagttgttaaggatgcttcaactggtctgaacttatttaattccaataagctcgactttacgacactttccaacgaacaagttaagaattataagaatgataagaactacttagttcggaagacggcttcaactttctacgttgaatttaatcgtaaggatagcgataagactttagtcaaagctttccagaacaagaagattcgtcaggctttgtcactagcaattaaccggaagtcctacgttaataatacgttaggtaacggttcgaccgtttctaaaggttacgtttctgaagacttagctaaaaacccgacaactggtaaggactttacgactgacgctgccgttccttctgcagttgactacaacttaacgaaagctaagaagttgtggaaagaaggaatgaaagaaattggtgaaactaagctgaacatcaagcttctttctgacgatactgatggtggtaagaagtctactgaatttattcaaggtgcttgggagaaattacctggtctgaccgttactaaccagaacgtcccattcaagacccgtcttcaacggtcacaaaacgggaacttcgatacagttatctctgcctggaatgctgactttactgacccaatctccttcttgtcactcttcacgtccgacaactcatacaacaatgggaagtatgacagtgccgcatacgacgatgctgtgaagaaggcggaaggtgccgatgccaataacaagactgcacgttgggctgatatggtcgctgctgaaaagcaattgatgaatgatcaaggggtcatcccaatctatcaacaagcctcagcaacgttgactcggagcaatctgaagggcatcatctacaacactgcgggctcaaactacaacttcaagtacatgtccgtaaaataatgatgtaaatccacagaaaaaagtgtgtgtgctttaactgaatgaatgtgaagcaaaggggtaaggattgacacattgttaatccttaccattttgttttataatgagggatgtcattattttttaagttgattttaatagaatgcgaggaattctcatgagaaagtatcttttaaagcggatattttacttgttcctgacattattcattgtggcgaccgccacgttcttcttaatgaagttaatgcccggaacaccgctgcaaaatgaagctaaattgacccctagcgaaaaggcgtcgatcttggcccaatacgggttggacaaacccgtttggttgcaatacttcatttacattggcgggatcttcaaggggagcttagggctatccttccagttctctgatcaagccgtcagttacctgattggtagccggatgggaccatcaatgcagttaggtggccaagcgatggtcgtcggaatcgtctttgggattatcctaggggccgttggtgccatcaagaaggatacttgggccgaccgtttagcaaccatcttatcgatcttagggatcgcagttccaagtttcgtgttagccatcctgttacaatactacctcggcttaaaggctggttggttcccagttgctggctgggaaggcttcgcttacacgatcttaccaacgttagctttggccgccagtccgctggccgaaacggctcggtttatccgaaccgacatggtggacgtgctgagttcggattatattgaactagctaaagccaaagggttgtcgaagtttggtatcgtgtatcaccatgcgttgcggaacagtttgattccaatggttacgctgattggaccattggccgccgccttgatgacgggttcaatggttgttgaaaatatcttctcagtacctgggattggggaacaattcgttaaatcaattctggttaacgactacccaaccatcatgggtgtgacgattttctattcagcactcctttgcttactattattgttgaccgatattgtctacggaattattgatccgcggattcgtttaaatggaaatggggactagttaatggcagaaaatccaagtagtatcgatattaagcccggcgacttcgagccgttagataaacaagcgggtcctgataatgaacggatcgcagcaccttccttaacgttcggccaagatgtctggcggcggttgaagtctaacaagaccgcttttatcagctttatcgtgttagtattcttattcttagtggcatttggtggacgggcagtctaccatgttgatccgaatgcacagtcaccacggtatgcgaacctccctccgaagattccgggtgttagtatccatggtttgaatggtcacttgactcaatctggtaaggacgttgatgcgtatgcggcggctggtgcaaagtctgacgtacattatcttctcgggactgattatctgggccgggacttactggcgcggattatgtatgggacccggatctcacttgaaattgcgttgattgctactttgattgacctgacgattggggtcggattcgggatactctccggttggaaaggtgggcgcgtcgatttattcatgcaacgtgtgattgaaatcctctcgtccatcccacaattggttatcatggtgttgatggccacggccttcacgaagactgggatggcctcaatcattgcggctatcgcgatcactggttggaccacgatggcccggctgactcgagcacagaccttgcaattgaagaaccaagattttattttggctgcgcggacattgggtgaatcacccgtcaagattgcttggaaacacttgttaccaaacctttcaagtgtcattattattcaaacgatgttcacgattccaagtgcgatcttcttcgaagcgttcttgagttatatcgggattgggatcagttcaccacaagcttcattggggacgttgatctctgatgggcagaagaacttccaattcttgccatatcagatgtggtacccagccatcgtgctgatcatcttgatgctcgcctttaacttgttaggtgacgggatgcgcgatgcgtttgatccaaagtcaaaacgttaggaggacggcagcactatggaaaaaccagaaaatgtgattgaggtccgcaacttggaaatcaatttccatacttatgcgggcgaagttaaagccatccgtgacgttagctttgatttacgtaagggtgaaaccttggcaattgttggtgaatcagggtctggtaagtcagtgacgacacgttcactgatgggcctgttagcacctaatgctgaaattaaacgtgggagcattatgttccacggtgaagatattattaaaaagtccgaaaaagacatgcaacacattcgtggtaaggatattgccatgatcttccaagatccaatgacatcattggacccaacaatgcggattgggatgcagattgcggaacctttgatgaaacataagggtttgaagaaaaaagaagcgattgcccaagcgctagagatgttgaaattggttgggattactaatcctgaaggccgaatcaatgattatccataccaattctcaggcgggatgcggcaacggattgtgattgcgattgcattggtctgctatcctgaagtcctgattgctgatgaaccaacgactgccttggacgtgacgattcaagcccagattctggacttgatgaaggatttacaaaatcgaattgatacgtcgattatctttatcacccatgacttaggtgtcgtggccggaatggctgatcgggtcgcagtgatgtatgccggtaaaatcgtggaatacgggacagtcgatgaaatcttcttcaatccacagcatccttatacctgggggttactcaattcgatgccaaccttggatactgaaagtggctcattatcagcgattccagggaccccaccagatttgttggaaccaccagttggtgacgcctttgcagcgcggagcgattacgcgatgaagattgatacggagaaggaacccccattctttaaggtttctgatacccattacgcggcaacctggttgcttcatccagatgccccaaaggtaacgccacctgctgaaatcgttcggcgtcagcaaaagtttgcggccatgcaaaaaccgcaagcaccaatttcaaatcccgtagcaaaggagtaagtagacatgcctgatgaacgtaaaaaaattctagaagttcgccatttaaagcagtattttaatgtcggcaaaaaagatgaagtccgggccgttgatgacgtctcctttgacatttatgaaggtgaaacatttgg
